US011781116B2

(12) United States Patent
Feary et al.

(10) Patent No.: US 11,781,116 B2
(45) Date of Patent: Oct. 10, 2023

(54) MAMMALIAN CELLS FOR PRODUCING ADENO-ASSOCIATED VIRUSES

(71) Applicant: LONZA LTD., Visp (CH)

(72) Inventors: Marc Feary, Suffolk (GB); Robert J. Young, London (GB); Anandita Seth, Sugar Land, TX (US)

(73) Assignee: LONZA LTD., Visp (CH)

( * ) Notice: Subject to any disclaimer, the term of this patent is extended or adjusted under 35 U.S.C. 154(b) by 812 days.

(21) Appl. No.: 16/486,360

(22) PCT Filed: Feb. 17, 2018

(86) PCT No.: PCT/IB2018/000239
§ 371 (c)(1),
(2) Date: Aug. 15, 2019

(87) PCT Pub. No.: WO2018/150271
PCT Pub. Date: Aug. 23, 2018

(65) Prior Publication Data
US 2020/0002682 A1    Jan. 2, 2020

Related U.S. Application Data

(60) Provisional application No. 62/460,457, filed on Feb. 17, 2017.

(51) Int. Cl.
C12N 15/86     (2006.01)
C12N 7/00      (2006.01)
C12N 15/90     (2006.01)

(52) U.S. Cl.
CPC ............. *C12N 7/00* (2013.01); *C12N 15/86* (2013.01); *C12N 15/90* (2013.01); *C12N 2750/14143* (2013.01); *C12N 2750/14152* (2013.01); *C12N 2800/30* (2013.01)

(58) Field of Classification Search
CPC ..................................................... C12N 15/86
See application file for complete search history.

(56) References Cited

U.S. PATENT DOCUMENTS

| | | | |
|---|---|---|---|
| 5,190,871 A | 3/1993 | Cox et al. |
| 5,656,491 A | 8/1997 | Cassani et al. |
| 5,658,776 A | 8/1997 | Flotte et al. |
| 5,837,484 A | 11/1998 | Trempe et al. |
| 6,033,885 A | 3/2000 | Latta et al. |
| 7,074,618 B2 | 7/2006 | Li et al. |
| 7,094,604 B2 | 8/2006 | Snyder et al. |
| 7,629,167 B2 | 12/2009 | Hodge et al. |
| 7,771,997 B2 | 8/2010 | Chen et al. |
| 8,236,293 B2 | 8/2012 | Fallaux et al. |
| 8,298,054 B2 | 10/2012 | Hodge et al. |
| 9,422,576 B2 | 8/2016 | Nishie et al. |
| 10,072,250 B2 | 9/2018 | Sakamoto et al. |
| 10,280,436 B2 | 5/2019 | Rance et al. |
| 2004/0087026 A1 | 5/2004 | Bertran et al. |
| 2004/0219516 A1 | 11/2004 | Bennett et al. |
| 2009/0305626 A1 | 12/2009 | Hope |
| 2011/0280797 A1 | 11/2011 | Mohtadi et al. |
| 2012/0077429 A1 | 3/2012 | Wernimont et al. |
| 2013/0280797 A1 | 10/2013 | Rao et al. |
| 2014/0127162 A1 | 5/2014 | Balazs et al. |
| 2016/0097074 A1 | 4/2016 | Collins et al. |

FOREIGN PATENT DOCUMENTS

| | | | | |
|---|---|---|---|---|
| EP | 2711428 A1 | 3/2014 | | |
| WO | 98/27207 A1 | 6/1998 | | |
| WO | 2013/190032 A1 | 12/2013 | | |
| WO | WO-2013190032 A1 * | 12/2013 | ............. | C07K 16/00 |
| WO | 2015/018703 A1 | 2/2015 | | |
| WO | 2015/031686 A1 | 3/2015 | | |
| WO | WO-2015031686 A1 * | 3/2015 | ............. | C12N 15/86 |

OTHER PUBLICATIONS

NCBI Printout NL1 locus sequence (Year: 2020).*
NCBI Printout NL2 locus sequence (Year: 2020).*
Argos et al., "The integrase family of site-specific recombinases: regional similarities and global diversity," EMBO J 5:433 (1986).
Bandaranayake et al., "Recent advances in mammalian protein production," Federation of European Biochemical Societies Letters 588(2):253-260 (2014).
Bannam et al., "Molecular genetics of the chloramphenicol-resistance transposon Tn4451 from Clostridium perfringens: the TnpX site-specific recombinase excises a circular transposon molecule.," Mol Microbiol 16:535-551 (1995).
Baser et al., "A method for specifically targeting two independent genomic integration sites for co-expression of genes in CHO cells," Methods 95:3-12 (2015).
Birch et al., "Antibody production," Adv Drug Delivery Rev, 58:671-685 (2006).
Carrasco et al., "Anabaena xisF gene encodes a developmentally regulated site-specific recombinase," Genes Dev 8:74-83 (1994).
Crellin et al., "The resolvase/invertase domain of the site-specific recombinase TnpX is functional and recognizes a target sequence that resembles the junction of the circular form of the Clostridium perfringens transposon Tn4451," J Bacteriol 179:5148-5156 (1997).
De Vries et al., "Increased virus replication in mammalian cells by blocking intracellular innate defense responses," Gene Ther 15:545-552 (2008).
Graham et al., "Characteristics of a human cell line transformed by DNA from human adenovirus type 5," J Gen Virol 36:59-74 (1977).
Kotin, "Prospects for the use of adeno-associated virus as a vector for human gene therapy," Human Gene Therapy 5:793-801 (1994).

(Continued)

*Primary Examiner* — Anoop K Singh
*Assistant Examiner* — David A Montanari
(74) *Attorney, Agent, or Firm* — MEDLER FERRO WOODHOUSE & MILLS PLLC

(57) ABSTRACT

A mammalian cell comprising at least four distinct recombination target sites (RTS), an adenovirus (Ad) gene comprising E1A, E1B or a combination thereof, and a promoter operatively linked to the Ad gene, wherein the RTS, the Ad gene, and the promoter are chromosomally-integrated; methods for using the cell for generating a recombinant adeno-associated virus (rAAV) producer host cell; and methods for using the AAV producer host cell to produce, package and purify rAAV.

12 Claims, 21 Drawing Sheets

Specification includes a Sequence Listing.

(56) References Cited

OTHER PUBLICATIONS

Kuhstoss et al., "Analysis of the integration function of the streptomycete bacteriophage phi C31," J Mol Biol 222:897-890 (1991).
Louis et al., "Cloning and Sequencing of the Cellular-Viral Junctions from the Human Adenovirus Type 5 Transformed 293 Cell Line," Virology 233:423-429 (1997).
Low et al., "Stabilization of the p53 tumor suppressor is induced by adenovirus 5 E1A and accompanies apoptosis," Genes Dev 7:535-545 (1993).
Matsuura et al., "The sre gene (ORF469) encodes a site-specific recombinase responsible for integration of the R4 phage genome," J Bacteriol 178:3374-3376 (1996).
Muzyczka, "Use of adeno-associated virus as a general transduction vector for mammalian cells," Current Topics in Microbiol and Immunol 158:97-129 (1992).
Ow et al., "Conditionally replicating plasmid vectors that can integrate into the Klebsiella pneumoniae chromosome via bacteriophage P4 site-specific recombination," J Bacteriol 155:704-713 (1983).
Porter et al., "Strategies for selecting recombinant CHO cell lines for cGMP manufacturing: improving the efficiency of cell line generation," Biotechnol Prog 26:1455-1464 (2010).
Qiao et al., "Feasibility of generating adeno-associated virus packaging cell lines containing inducible adenovirus helper genes," J Virol 76:1904-1913 (2002).
Robert et al., "Manufacturing of recombinant adeno-associated viruses using mammalian expression platforms," Biotechnology Journal 12(3):1600193 (2017).
Samulski et al., "AAV-Mediated Gene Therapy for Research and Therapeutic Purposes," Annu Rev Virol 1:427-451 (2014).
Sanber et al., "Construction of stable packaging cell lines for clinical lentiviral vector production," Scientific Reports 5(1):1-74 (2015).
Sato et al., "The cisA cistron of Bacillus subtilis sporulation gene spoIVC encodes a protein homologous to a site-specific recombinase," J Bacteriol 172:1092-1098 (1990).
Sauer, "Functional expression of the cre-lox site-specific recombination system in the yeast Saccharomyces cerevisiae," Mol Cell Biol 7:2087-2096 (1987).
Sauer et al., "Site-specific DNA recombination in mammalian cells by the Cre recombinase of bacteriophage P1," Proc Natl Acad Sci USA 85:5166-5170 (1988).
Stragier et al., "Chromosomal rearrangement generating a composite gene for a developmental transcription factor," Science 243:507-512 (1989).
Strathdee et al., "Expression of Transgenes Targeted to the Gt(ROSA) 26or Locus is Orientation Dependent," PLOS One 1:e4 (2006).
Thorpe et al., "In vitro site-specific integration of bacteriophage DNA catalyzed by a recombinase of the resolvase/invertase family," Proc Natl Acad Sci USA, 95:5505-5510 (1998).
Tjio et al., "Genetics of Somatic Mammalian Cells," Exp Med 108:259-268 (1958).
Turan et al., "Multiplexing RMCE: Versatile Extensions of the Flp-Recombinase-Mediated Cassette-Exchange Technology," Journal of Molecular Biology 402(1):52-69 (2010).
Wirth et al., "Road to precision: recombinase-based targeting technologies for genome engineering," Curr Opin Biotech 18:411-419 (2007).
International Search Report issued in International Application No. PCT/IB2018/000239, dated Jul. 27, 2018.
Koichi Miyake et al., Journal of the Japanese Medical University, 2012, 8(2): 150-156. (English abstract provided).

* cited by examiner

Figure 2: pMF30.

Figure 3: pMF23.

Figure 4: pXC17.4_17Ad5PerProKZ

Figure 20. Titers of rAAV2.GFP from HEK293 and CHO cells

| | 1# | 2# | 3# | 4# | 5# |
|---|---|---|---|---|---|
| HEK293 | | | pHelper | | |
| CHOK1SV GS-KO | | | wt Ad5 (500 MOI) | | |
| Rep-Cap vector | pLMC32 | pLMC33 | pLMC34 | pLMC35 | pRC2-mi342 |
| GOI vector | | pLMC31 | | | pAAV-GFP |
| Titer/HEK293(vg/ml) | 4.9E+09 | 2.9E+09 | 2.9E+09 | 2.2E+09 | 8.4E+08 |
| Titer/CHO (vg/ml) | 1.4E+07 | 1.3E+07 | 1.8E+07 | 2.3E+07 | 3.7E+07 |

Figure 21. Primer sequences for TaqMan-qPCR and PCR analysis

| Oligo Name | Sequence (5' to 3') |
|---|---|
| Rep-Cap-P1-F | TTTGGGACGTTTCCTGAGTC |
| Rep-Cap-P1-R | CTCATCCACCACCTTGTTCC |
| Rep-Cap-P2-F | GCAAGACCGGATGTTCAAAT |
| Rep-Cap-P2-R | CCTCAACCACGTGATCCTTT |
| Rep-Cap-P3-F | CTGCAGACAATGCGAGAGAA |
| Rep-Cap-P3-R | CGACAGAAACGGGTTGAGAT |
| Rep-Cap-P4-F | GAGTGACATTCGGGACCAGT |
| Rep-Cap-P4-R | GTCTCTGCCATTGAGGTGGT |
| E1A-F | GAGGACCTGTGGCATGTTTG |
| E1A-R | CATTTTAGGACGGCGGGTAG |
| E1B-19K-F | GAAGTCCTGTGGTGAGCTGT |
| E1B-19K-R | TGGCCAGAAAATCCAGCAGG |
| E1B-55K-F | CTGGAAGGTGCTGAGGTACG |
| E1B-55K-R | CTCAGCTCCTCGGTCACATC |
| E2A-F | CTTTGGTAGCTGCCTTCCCA |
| E2A-R | GTATCCTAACGCCCAGACCG |
| E4-F | TAATAAACTCCCCGGGCAGC |
| E4-R | ACAACGCGTGGACTTCTC |
| VAI-F | CACTCTTCCGTGGTCTGGTG |
| VAI-R | GTTGTCTGACGTCGCACAC |
| VAII-F | TTTCCAAGGGTTGAGTCGCA |
| VAII-R | GAATTTGCAAGCGGGGTCTT |
| Actin-F | CGACATCCGCAAAGACCTCT |
| Actin-R | AGGATGCTTAGCTCACCTTGA |
| Fer1L4 with Rep-Cap integrated-P5-F | GGAGTTCAAAGCCAGCTTATACCAACATG |
| Fer1L4 with Rep-Cap integrated-P5-R | GCTAAAGTTGGTATGGCAGCCTGCACC |
| Fer1L4 landing pad-P6-F | GGATCACTCTCGGCATGGACGAG |
| Fer1L4 landing pad-P6-R | CCTCTTCTTCAGCCACAGTCACTTC |
| NL1 with GOI integrated-P7-F | GCAGCACGAACAAGAGTCAC |
| NL1 with GOI integrated-P7-R | GAACCTGCGTGCAATCCATC |
| NL1 landing pad-P8-F | GGACATATCTGGGTGAAGGGAGCTG |
| NL1 landing pad-P8-R | CAGCCGCACGGTAGGCTTGTACTCGGTCAT |

MAMMALIAN CELLS FOR PRODUCING ADENO-ASSOCIATED VIRUSES

SEQUENCE LISTING

The instant application contains a Sequence Listing which has been submitted electronically in ASCII format and is hereby incorporated by reference in its entirety. Said ASCII copy, created on Mar. 28, 2018, is named 0132-0025WO1_SL.txt and is 8,516,061 bytes in size.

FIELD OF THE INVENTION

The present disclosure relates to a mammalian cell comprising at least four distinct recombination target sites (RTS), an adenovirus (Ad) gene comprising E1A, E1B or a combination thereof, and a promoter operatively linked to the Ad gene, wherein the RTS, the Ad gene, and the promoter are chromosomally-integrated. The disclosure also relates to a method for using the cell to generate a recombinant adeno-associated virus (rAAV) producer cell and methods for using the rAAV producer cell to produce, package and purify rAAV without live helper virus.

BACKGROUND OF THE INVENTION

The use of recombinant adeno-associated virus (rAAV) is being aggressively pursued in clinical development to obtain long-lasting, efficient delivery of gene therapy products. Baculovirus-based platforms for rAAV production often require raw materials that can be variable and time consuming to generate. Triple transfection and transient expression in HEK293 can be limited by poor scalability. Existing scalable HeLa cell based producer cell line processes require wild-type (wt) adenovirus 5 (Ad5) as a helper virus, and clearance of helper virus in the final product is critical due to safety concerns. When constructing a cell line to produce rAAV, the gene of interest and ancillary helper genes can be either expressed transiently or integrated into the host chromosome. Conventional DNA transduction routes used for the modification of the cellular genome can be subject to unpredictable alterations and are not easily inter changeable to adjust for the differing requirements of virus serotypes.

Therapeutic recombinant adeno-associated virus (AAV) constructs are replication defective and require co-infection of wt adenovirus (Ad) for replication and subsequent rounds of infection. Generation of therapeutic recombinant adeno-associated virus (rAAV) vectors generally requires three different components be supplied to the host: (i) the adeno-associated virus genes Rep/Cap that provide replication and packaging elements, (ii) the helper virus functions from Ad genome for virus packaging, and (iii) a gene of interest (GOI) of interest located between 3' and 5' AAV inverted terminal repeat sequences (ITR). The Ad genes required for efficient gene expression, DNA replication and packaging are thought to include E1A, E1B, E2A, E4 and VA RNA. E1A is proposed to be the earliest gene product made during Ad infection (Shenk, T. et al., Fields Virology, $3^{rd}$ ed., 2211-2148 (1996)). E1A is believed to act as a cue to begin virus replication by up-regulating transcription from the AAV Rep gene promoters, p5 and p19 and by activating early adenovirus promoters for E1B, E2A and E4. E1A is also believed to be used to drive the host cells into the S-phase of the cell cycle for viral DNA replication as the AAV encoded proteins (Rep and Cap) are not capable of this function. An adverse effect of EA is that it stabilizes p53, which leads to apoptosis (Low et al., Genes & Dev. 7:535-545 (1993)). Leaky expression of E1A can turn on Ad genes as well as the AAV Rep gene. The latter is reported to be cytostatic and cytotoxic, making it difficult to obtain a stable cell line from cells that constitutively express E1A. Regulated E1A gene expression appears to be critical to the success of a helper virus free AAV packaging cell line.

Different cell lines and different approaches to bringing these elements together to produce rAAV have been attempted. These different cell lines include HEK293 and HeLa cell lines. The different approaches have also included the use of the baculovirus system. However, each cell line and approach has its drawbacks and none is an ideal platform for scalable, robust rAAV production process.

One rAAV production process includes HEK293 cells, which were generated by transfection of primary embryonic kidney cells using physically sheared Ad5 DNA (Graham F. L. et al., J. Gen. Virol. 36:59-74 (1977)). Genomic analysis reportedly demonstrated that HEK293 cells carry an integrated fragment of the left-hand end of the adenovirus genome (bases 1-4344), containing the E1 region and additional flanking sequences (Louis N. et al, Virology 233:423-9 (1997)). Some triple-transfection processes have used adherent HEK293 cells for transfection with plasmids containing the remaining essential elements. Although using HEK293 in rAAV production is possible, an adherent cell based process in not scalable to meet the increasing vector needs for various indications and relies on transient transfection instead of a stable producer cell line.

A second rAAV production process features generation and selection of stably transfected HeLa cell clones that contain both the AAV genes Rep/Cap and the GOI. These cell lines then can be infected by wt Ad5 to trigger the packaging of rAAV particles. While this method is scalable, the generation of these clones can be a long and labor intensive process and the removal of wt Ad5 virus from the final product of this process adds multiple steps to the process.

A third rAAV production process relies on recombinant baculovirus for introducing AAV genes (Rep/Cap) and directly performs the necessary helper virus functions for rAAV production in SF9 insect cells. While this method is scalable in suspension culture, it requires generation of plaque purified recombinant baculovirus constructs, and results in a longer time to product development.

A novel, efficient platform for rAAV production, which addresses these deficiencies by providing a rapid process to generate a stable producer cell line for any desired AAV serotype that additionally provides high, scalable production yields without the addition of live helper virus is needed to provide high-quality vectors for use in both preclinical and clinical studies.

The type I interferons (IFN) were the first cytokines discovered and named for their potent ability to "interfere" with viral replication. Many viral products can block the IFN associated signal, such as the influenza NS1 protein and vaccinia virus E3L protein which inhibit protein kinase (PKR), and vaccinia virus-encoded soluble IFN-alpha/beta receptor decoys.

Chinese hamster ovary (CHO) cells (Puck, J. Exp. Med., 108: 259-268 (1958)) are a well characterized cell line often used for the commercial production of recombinant proteins from mammalian cells due to their high productivity, robust nature, safety record and track record in industry (Birch and Racher, Adv. Drug Delivery Rev., 58:671-685 (2006)). However, CHO cells have not been previously used in the production of rAAV.

Various publications are cited herein, the disclosures of which are incorporated by reference herein in their entireties.

BRIEF DESCRIPTION OF THE INVENTION

In some embodiments, the present disclosure provides a mammalian cell comprising (i) at least four distinct recombination target sites (RTS), (ii) an adenovirus (Ad) gene comprising E1A, E1B or a combination thereof, and (iii) a promoter operatively linked to an Ad gene, wherein the RTS, the Ad gene, and the promoter are chromosomally-integrated. In some embodiments, the cell is a mouse cell, a human cell, a Chinese hamster ovary (CHO) cell, a CHO-K1 cell, a CHO-DXB11 cell, a CHO-DG44 cell, a CHOK1SV™ cell (Lonza, Slough, UK) including all variants, a CHOK1SV GS-KO™ (glutamine synthetase knockout) cell (Lonza, Slough, UK) including all variants, a HEK293 cell including adherent and suspension-adapted variants, a HeLa cell, or a HT1080 cell. In some embodiments, the cell comprises four RTSs. In some embodiments, the cell comprises six RTSs. In some embodiments, at least one RTS is selected from the group consisting of SEQ ID NOs.: 1-30. In some embodiments, at least one RTS, the Ad gene, and the promoter are integrated at a single chromosomal locus. In some embodiments, the chromosomal locus is Fer1L4, ROSA26, HGPRT, DHFR, COSMC, LDHa, MGAT1, GRIK1, NL1, NL2, the first intron of MID1 on the X chromosome, or enhanced expression and stability regions (EESYRs, see, e.g., U.S. Pat. No. 7,771,997). In some embodiments, the cell comprises a site-specific recombinase gene. In some embodiments, the site-specific recombinase gene is chromosomally-integrated. In some embodiments, the cell comprises a second Ad gene, wherein the second Ad gene is chromosomally-integrated. In some embodiments, the second Ad gene comprises E1A, E1B, E2A, E4, VA, MIR342, or a combination thereof. In some embodiments, the second Ad gene is from Ad5. In some embodiments, the second Ad gene is located between two of the RTS. In some embodiments, the cell further comprises an adeno-associated virus (AAV) gene, wherein the AAV gene is chromosomally-integrated. In some embodiments, the AAV gene comprises Rep, Cap, or a combination thereof. In some embodiments, the AAV gene is from adeno-associated virus type 2. In some embodiments, the AAV gene is located between two of the RTS. In some embodiments, the cell further comprises an AAV vector cassette, wherein the AAV vector cassette is chromosomally-integrated. In some embodiments, the AAV vector cassette comprises a reporter gene, a selection gene, a gene of therapeutic interest, or a combination thereof. In some embodiments, the AAV vector cassette is located between two of the RTS. In some embodiments, the cell is substantially free of helper virus.

In some embodiments, the present disclosure provides a mammalian cell comprising (i) at least four distinct recombination target sites (RTS), (ii) an Ad gene E2A, E4, VA, MIR342 or a combination thereof, and (iii) a promoter operatively linked to the Ad gene, wherein the RTS, the Ad gene and the promoter are chromosomally-integrated. In some embodiments, the cell is a mouse cell, a human cell, a Chinese hamster ovary (CHO) cell, a CHO-K1 cell, a CHO-DXB11 cell, a CHO-DG44 cell, a CHOK1SV™ cell including all variants, a CHOK1SV GS-KO™ (glutamine synthetase knockout) cell including all variants, a HEK293 cell including adherent and suspension-adapted variants, a HeLa cell, or a HT1080 cell. In some embodiments, the cell comprises four RTSs. In some embodiments, the cell comprises six RTSs. In some embodiments, at least one RTS is selected from the group consisting of SEQ ID Nos.: 1-30. In some embodiments, the RTS, the Ad gene, and the promoter are integrated at a single chromosomal locus. In some embodiments, the chromosomal locus is Fer1L4, ROSA26, HGPRT, DHFR, COSMC, LDHa, MGAT1, GRIK1, NL1, NL2, the first intron of MID1 on the X chromosome, or enhanced expression and stability regions (EESYRs). In some embodiments, the cell comprises a site-specific recombinase gene. In some embodiments, the site-specific recombinase gene is chromosomally-integrated. In some embodiments, the cell further comprises a second Ad gene, wherein the second Ad gene is chromosomally-integrated. In some embodiments, the second Ad gene comprises E1A, E1B, E2A, E4, VA, MIR342, or a combination thereof. In some embodiments, the second Ad gene is from Ad5. In some embodiments, the second Ad gene is located between two of the RTS. In some embodiments, the cell further comprises an adeno-associated virus (AAV) gene, wherein the AAV gene is chromosomally-integrated. In some embodiments, the AAV gene comprises Rep, Cap, or a combination thereof. In some embodiments, the AAV gene is from adeno-associated virus type 2. In some embodiments, the AAV gene is located between two of the RTS. In some embodiments, the cell further comprises an AAV vector cassette, wherein the AAV vector cassette is chromosomally-integrated. In some embodiments, the AAV vector cassette comprises a reporter gene, a selection gene, a gene of therapeutic interest or a combination thereof. In some embodiments, the AAV vector cassette is located between two of the RTS. In some embodiments, the cell is substantially free of helper virus.

In some embodiments, the present disclosure provides a mammalian cell comprising (i) at least four distinct recombination target sites (RTS), (ii) and an adeno-associated virus (AAV) gene comprising Rep, Cap, or a combination thereof, wherein the RTS and the AAV gene are chromosomally-integrated. In some embodiments, the AAV gene is from adeno-associated virus type 2. In some embodiments, the cell is a mouse cell, a human cell, a Chinese hamster ovary (CHO) cell, a CHO-K1 cell, a CHO-DXB11 cell, a CHO-DG44 cell, a CHOK1SV™ cell including all variants, a CHOK1SV GS-KO™ cell including all variants, a HEK293 cell including adherent and suspension-adapted variants, a HeLa cell, or a HT1080 cell. In some embodiments, the cell comprises four RTS. In some embodiments, the cell comprises six RTS. In some embodiments, at least one RTS is selected from the group consisting of SEQ ID NOs.: 1-30. In some embodiments, the RTS and the AAV gene are integrated at a single chromosomal locus. In some embodiments, the chromosomal locus is Fer1L4, ROSA26, HGPRT, DHFR, COSMC, LDHa, MGAT1, GRIK1, NL1, NL2, the first intron of MID1 on the X chromosome, or Enhanced Expression and stability regions (EESYRs). In some embodiments, the cell comprises a site-specific recombinase gene. In some embodiments, the site-specific recombinase gene is chromosomally-integrated. In some embodiments, the cell further comprises an Ad gene and a promoter operatively linked to the Ad gene, whereby the Ad gene and the promoter are chromosomally-integrated. In some embodiments, the Ad gene comprises E1A, E1B, E2A, E4, VA, MIR342 or a combination thereof. In some embodiments, the Ad gene is from Ad5. In some embodiments, the AAV gene is located between two of the RTS. In some embodiments, the cell further comprises an AAV vector cassette, wherein the AAV vector cassette is chromosomally-integrated. In some embodiments, the AAV vector cassette comprises a reporter gene, a selection gene, a gene of therapeutic interest or a combination thereof. In some embodiments, the AAV vector cassette is located between two of the RTS. In some embodiments, the cell is substantially free of helper virus.

In some embodiments, the present disclosure provides a Chinese hamster ovary (CHO) cell comprising: six distinct recombination target site (RTS) wherein at least one RTS is selected from the group consisting of SEQ ID NOs. 1-30, an adenovirus (Ad) gene comprising E1A and E1B, a promoter operatively linked to the Ad gene, wherein the RTS, the Ad gene and the promoter are chromosomally-integrated, a second Ad gene comprising E2A, E4, VA, and M1R342, wherein the second Ad gene is chromosomally-integrated and located between two of the RTS, an adeno-associated virus (AAV) gene comprising Rep and Cap, wherein the AAV gene is chromosomally-integrated and located between two of the RTS, and an AAV vector cassette comprising a reporter gene, a selection gene or a gene of therapeutic interest, wherein the AAV vector cassette is chromosomally-integrated and located between two of the RTS.

In some embodiments, the present disclosure provides a Chinese hamster ovary (CHO) cell comprising an adenovirus (Ad) gene comprising E1A and E1B and a promoter operatively linked to the Ad gene, a second Ad gene comprising E2A, E4, VA, and MIR342, an adeno-associated virus (AAV) gene comprising Rep and Cap, and an AAV vector cassette comprising a reporter gene, a selection gene, a gene of therapeutic interest or a combination thereof.

In some embodiments, the present disclosure provides a method for producing a recombinant adeno-associated virus (rAAV) producer cell comprising: providing a cell that comprises at least four distinct recombination target sites (RTS), an adenovirus (Ad) gene comprising E1A, E1B, or a combination thereof, and a promoter operatively linked to the Ad gene, wherein the RTS, the Ad gene and the promoter are chromosomally-integrated, transfecting the cell provided with a vector comprising an exchangeable cassette encoding an adeno-associated virus (AAV) gene, a second Ad gene, an AAV vector cassette, or a combination thereof, integrating the exchangeable cassette into the chromosome, and selecting rAAV producer cells with the exchangeable cassette integrated into the chromosome. In some embodiments, the transfection is with two vectors, the first vector comprising an exchangeable cassette comprising the second Ad gene and the AAV gene and the second vector comprising an exchangeable cassette comprising the AAV vector cassette. In some embodiments, the transfection is with two vectors, the first vector comprising an exchangeable cassette comprising the second Ad gene and the second vector comprising an exchangeable cassette comprising the AAV gene. In some embodiments, the transfection is with three vectors, the first vector comprising an exchangeable cassette comprising the second Ad gene, the second vector comprising an exchangeable cassette comprising the AAV gene, and the third vector comprising the exchangeable cassette comprising the AAV vector cassette. In some embodiments, each exchangeable cassette further comprises two RTS, matching two of the RTS of the cell. In some embodiments, the second Ad gene comprises E1A, E1B, E2A, E4, VA, MIR342, or a combination thereof. In some embodiments, the AAV gene comprises Rep, Cap, or a combination thereof. In some embodiments, the AAV vector cassette comprises a reporter gene, a selection gene, a gene of therapeutic interest or a combination thereof.

In some embodiments, the present disclosure provides a method for producing recombinant adeno-associated virus (rAAV) comprising of (i) infecting a host cell with rAAV, (ii) producing rAAV packaged with an AAV vector cassette, and (iii) purifying the packaged rAAV, wherein the host cell comprises: at least four distinct recombination target sites (RTS), an adenovirus (Ad) gene comprising E1A, E1B or a combination thereof, a promoter operatively linked to the Ad gene, wherein the RTS, the Ad gene and the promoter are chromosomally-integrated a second Ad gene comprising E1A, E1B, E2A, E4, VA, MIR342, or a combination thereof, an adeno-associated virus (AAV) gene comprising Rep, Cap, or a combination thereof, and the AAV vector cassette comprising a reporter gene, a selection gene, a gene of therapeutic interest or a combination thereof. In some embodiments, no live wild-type helper virus is required for rAAV production and packaging. In some embodiments, expression of E1A is not required for rAAV production. In some embodiments, a minimum of $1.0 \times 10^9$ vg/mL active AAV is obtained after purification.

BRIEF DESCRIPTION OF THE DRAWINGS

FIG. 1A shows a schematic of the experimental design. FIG. 1B shows the detection of green fluorescent protein (GFP) signals in transfected CHOK1SV GS-KO™ cells (left) and HEK293 cells infected with lysate from transfected CHOK1SV GS-KO™ cells (right). FIG. 1C shows the quantification of rAAV titer CHOK1SV GS-KO™ and HEK293 (control) cells by qPCR analysis of viral genomic DNA.

FIG. 5A is a schematic of the experimental design. FIG. 5B shows agarose gel analysis of genomic PCR products for E1A in HEK293F, HEK293L, CHOK1SV GS-KO™ and the CHOK1SV GS-KO™ MOCK and CHOK1SV GS-KO™ (E1A_E1B) pools. FIG. 5C shows agarose gel analysis of genomic PCR products for E1B in HEK293F, HEK293L, CHOK1SV GS-KO™ host and the CHOK1SV GS-KO™ MOCK and CHOK1SV GS-KO™ E1A_E1B pools. FIG. 5D shows agarose gel analysis of RT-PCR products for E1A in HEK293F, HEK293L, CHOK1SV GS-KO™ host and the CHOK1SV GS-KO™ MOCK and CHOK1SV GS-KO™ E1A_E1B pools treated with doxycycline. FIG. 5E shows agarose gel analysis of RT-PCR products for E1B in HEK293F, HEK293L, CHOK1SV GS-KO™ and the CHOK1SV GS-KO™ MOCK and CHOK1SV GS-KO™ E1A_E1B pools treated with doxycycline. Panel F shows western blot analysis of protein lysates for E1A and β-actin in the CHOK1SV GS-KO™ MOCK and CHOK1SV GS-KO™ E1A_E1B pools.

FIG. 7A shows the arrangement of landing pad 1 containing a single or dual function report/marker gene. The reporter gene is under the control of a SV40E promoter and has an SV40 PolyA sequence. Incompatible Frt sites are located between the SV40 promoter and hpt-eGFP gene (Frt-A) and 5' of the SV40 poly A sequence (Frt-B) for recombinase-mediated cassette-exchange (RMCE). FIG. 7B and FIG. 7C show the arrangement of subsequent landing pads contain incompatible Frt sites (C, D, E and F) and a different reporter to allow independent targeting of payload sequences. In this instance Frt sites A-F could be any of those described in Table 2.

FIG. 8A shows the arrangement for a single site CHOK1SV GS-KO™ and HEK293 host. The Ad helper genes are integrated at an SSIS and GOI/Rep/Cap genes are expressed transiently from a plasmid. FIG. 8B shows the arrangement for a double site CHOK1SV GS-KO™ and HEK293 host. The Ad helper and Rep/Cap genes are integrated at two separate SSISs and GOIs are expressed transiently from a plasmid. FIG. 8C shows the arrangement for a triple site CHOK1SV GS-KO™ and HEK293 host. The helper, Rep/Cap and GOI genes are integrated at three separate SSISs. In some instances, the E1A and E1B genes are also integrated in a SSIS to enhance expression.

FIG. 10A shows schematically the architecture of vector pLMC31 (encoding an rAAV vector with an eGFP reporter gene flanked by ITRs at either end of the AAV cassette). The selection marker in this vector is the Neomycin phosphotransferase I gene and Frt sites are arranged for targeting to NL1. FIG. 10B shows schematically the architecture of vector pLMC32 (encoding AAV2 Rep/Cap genes. This vector includes the min p5 promoter (white square) 5' of Rep, containing two enhancer elements to reduce Rep expression and inhibition of rAAV production, and a full p5 promoter (black and white square) 3' of Cap to enhance Cap expression. FIG. 10C shows schematically the architecture of vector pLMC33 (encoding AAV2 Rep/Cap.genes). This vector includes the min p5 promoter (white square) 5' of Rep and a p5$^{mut}$ promoter (black and grey square) with the TATA box mutated to GGGGGGG to reduce promoter activity 3' of Cap. FIG. 10D shows schematically the architecture of vector pLMC34 also encoding AAV2 Rep/Cap genes. The vector includes the wild-type p5 promoter (black and white square) 5' of Rep, and a mutated p5 promoter (black and grey square) 3' of Cap. FIG. 10E shows schematically the architecture of vector of pLMC35 (also encoding AAV2 Rep/Cap genes). This vector includes the mutated p5 promoter (black and grey square) 5' of Rep and 3' of Cap. The selection marker in pLMC32 to pLMC35 is GS cDNA and Frt sites are arranged for targeting to Fer1L4.

FIG. 11. A shows the level of three E1A isoforms: E1A 289R, E1A 243R and E1A 171R (Radko et al. (2015) *PLoS One*. 10:e0140124). E1A protein levels were detected using a mouse anti-E1A antibody diluted 1:1000 (Abcam, ab33183). The molecular weight of E1A, Rep and Cap protein isoforms are shown in brackets. There was no change in E1A protein levels in HEK293 or CHOK1SV GS-KO™ cells transfected with different vectors, but the protein level of each E1A isoform was different between HEK293 and CHOK1SV GS-KO™ cells. FIG. 11. B shows the levels of Rep78 and Rep52 protein. Rep protein levels were detected using a mouse anti Rep antibody diluted 1:1000 (ARP, 03-61069). Shown in brackets is the molecular weight. There was no change in Rep52 protein levels in HEK293 or CHOK1SV GS-KO™ cells transfected with different vectors, but Rep78 protein levels were higher in cells transfected with pLMC34 and pLMC35. FIG. 11. C shows the level of three Cap isoforms: VP1, VP2 and VP3 using a mouse anti Cap antibody diluted 1:1000 (ARP, 03-61058). Shown in brackets is the molecular weight. There was no change in VP3 protein levels in HEK293 cells transfected with different vectors, and VP1 and VP2 were not detectable in HEK293 cells. VP1, VP2 and VP3 were not detectable in CHOK1SV GS-KO™ cells. FIG. 11. D shows the beta-actin loading control using a mouse anti beta-actin antibody diluted 1:1000 (TFS, MA5-1573).

FIG. 15A shows agarose gel analysis of genomic DNA PCR products for specific Rep/Cap integration into a landing pad located in the Fer1L4 gene using primer set P5. The expected product size is 1524 bp. Results show specific Rep/Cap integration into a landing pad located in the Fer1L4 gene in 'A' Pools 4, 5, 6, 7, 9, 11, 17, 18, 19, 21 and all of the analysed 'B' Pools. As expected, specific Rep/Cap integration was not detected in the CHOK1SV GS-KO™ and CHOK1SV GS-KO™ SSI host. FIG. 15B shows agarose gel analysis of genomic DNA PCR products for residual landing pad in the Fer1L4 gene using primer set P6. The expected product size is 487 bp. Results show some residual landing pad, and incomplete Rep/Cap integration into a landing pad located in the Fer1L4 gene in all of 'A' Pools, except 18, and all of 'B' Pools. There was a smaller PCR product in 'A' Pool 19, indicating loss of a part of sequence. As expected, the Fer1L4 landing pad was amplified in CHOK1SV GS-KO™ cells, but not detected in the CHOK1SV GS-KO™ SSI host.

FIG. 16A shows agarose gel analysis of genomic DNA PCR products for specific GOI integration into the NL1 landing pad using primer set P7. The expected product size is 1446 bp. Results show specific GOI integration into a landing pad located in the NL1 locus in all of 'B' Pools but not in 'A' Pools. As expected, specific GOI integration was not detected in the CHOK1SV GS-KO™ and CHOK1SV GS-KO™ SSI host. FIG. 16B shows agarose gel analysis of genomic DNA products for residual NL1 landing pad using primer set P8. The expected product size is 809 bp. Results show some residual landing pad, and incomplete GOI integration into a landing pad located in the NL1 gene in all of 'A' Pools, except 11, and all of 'B' Pools. According to the results, the NL1 landing pad was not intact in 'A' Pool 11, but GOI had not integrated into the landing pad. As expected, the NL1 landing pad was amplified in CHOK1SV GS-KO™ cells, but not detected in the CHOK1SV GS-KO™ SSI host.

FIG. 17. A shows the level of three E1A isoforms: E1A 289R, E1A 243R and E1A 171R. E1A protein levels were detected using a mouse anti-E1A antibody diluted 1:1000 (Abcam, ab33183). The molecular weight of E1A, Rep and Cap protein isoforms are shown in brackets. The levels of all three E1A isoforms were the same in all pools, and slightly higher than in CHOK1SV GS-KO™ cells. FIG. 17. B shows the levels of Rep78 and Rep52 protein. Rep protein levels were detected using a mouse anti Rep antibody diluted 1:1000 (ARP, 03-61069). Shown in brackets is the molecular weight. Rep78 was not detectable. Rep52 was detected in 'A' Pool 13 and 'B' Pools 6, 7, 8 and 10, indicated by *. FIG. 11. C shows the level of three Cap isoforms: VP1, VP2 and VP3 using a mouse anti Cap antibody diluted 1:1000 (ARP, 03-61058). Shown in brackets is the molecular weight. VP1, Vp2 and VP3 were not detected. FIG. 17. D shows the beta-actin loading control using a mouse anti beta-actin antibody diluted 1:1000 (TFS, MA5-1573).

FIG. 19.A shows Rep78 and Rep68 mRNA levels. ~6- and ~5-fold induction was observed in HEK293 and CHOK1SV GS-KO™ cells (respectively) following triple transfection. FIG. 19.B shows Rep78, Rep68, Rep52, and Rep40 mRNA levels. ~11- and ~5-fold induction was observed in HEK293 and CHOK1SV GS-KO™ cells (respectively) following triple transfection. FIG. 19.C shows Rep78 and Rep52 mRNA levels. ~17- and ~4-fold induction was observed in HEK293 and CHOK1SV GS-KO™ cells (respectively) following triple transfection. FIG. 19.D shows total Rep and Cap mRNA levels. ~20- and ~7-fold induction was observed in HEK293 and CHOK1SV GS-KO™ cells (respectively) following triple transfection. FIG. 19.E shows E1A mRNA levels. ~1-fold induction was observed in HEK293 following triple transfection. E1A mRNA was not detected in control CHOK1SV GS-KO™ cells, but was detected following transfection and infection with wt Ad5. FIG. 19. F shows E1B-19K mRNA levels. ~1-fold induction was observed in HEK293 following triple transfection. E1B-19K mRNA was not detected in control CHOK1SV GS-KO™ cells, but was detected following transfection and infection with wt Ad5. FIG. 19.G shows E1B-55K mRNA levels. ~1-fold induction was observed in HEK293 following triple transfection. E1B-55K mRNA was not detected in control CHOK1SV GS-KO™ cells, but was detected following transfection and infection with wt Ad5. FIG. 19.H shows E2A mRNA levels. E2A mRNA was not detectable in control samples, and was present following triple transfection. FIG. 19.I shows E4 mRNA levels. E4 mRNA was not detectable in control samples, and was present following triple transfection. FIG. 19.J shows VAI mRNA levels. VAI mRNA was not detectable in control samples, and was present following triple transfection. FIG. 19.K shows VAII mRNA levels. VAII mRNA was not detectable in control samples, and was present following triple transfection. All of the observed mRNA levels, except E4 were lower in CHOK1SV GS-KO™ in comparison with HEK293 cells (FIG. 19.A-K). These data show that the Rep-Cap mRNA induction and expression were lower in CHOK1SV GS-KO™ cells in comparison with HEK293 cells.

FIG. 20 shows the titers of rAAV from triple transfected HEK293 and CHOK1SV GS-KO™ cells. HEK293 cells were transfected with pHelper (6234, Clontech) and one pLMC32-35 or pRC-mi342 (6234, Clontech) and pLMC31 or pAAV-GFP (AAV-400, Cell Biolabs) vectors. CHOK1SV GS-KO™ cells were infected with wt Ad5 and one pLMC32-35 or pRC-mi342 (6234, Clontech) and pLMC31 or pAAV-GFP (AAV-400, Cell Biolabs) vectors. Three days after transfection, DNA was extracted for TaqMan-qPCR analysis for AAV expression. The AAV titer produced by CHOK1SV GS-KO™ cells was lower than in HEK293 cells, and the titers produced by triple transfected HEK293 cells using pHelper (6234, Clontech), pLMC31 and pLMC32-35 were significantly higher than in HEK293 cells triple transfected using the Clontech vectors (pHelper (6234, Clontech), pRC2-mi342 (6234, Clontech) and pAAV-GFP (AAV-400, Cell Biolabs).

FIG. 21 shows the primer sequences (SEQ ID NOS 43-74, respectively, in order of appearance) used for TaqMan-qPCR and genomic DNA PCR analysis.

DETAILED DESCRIPTION OF THE INVENTION

Figure 1:
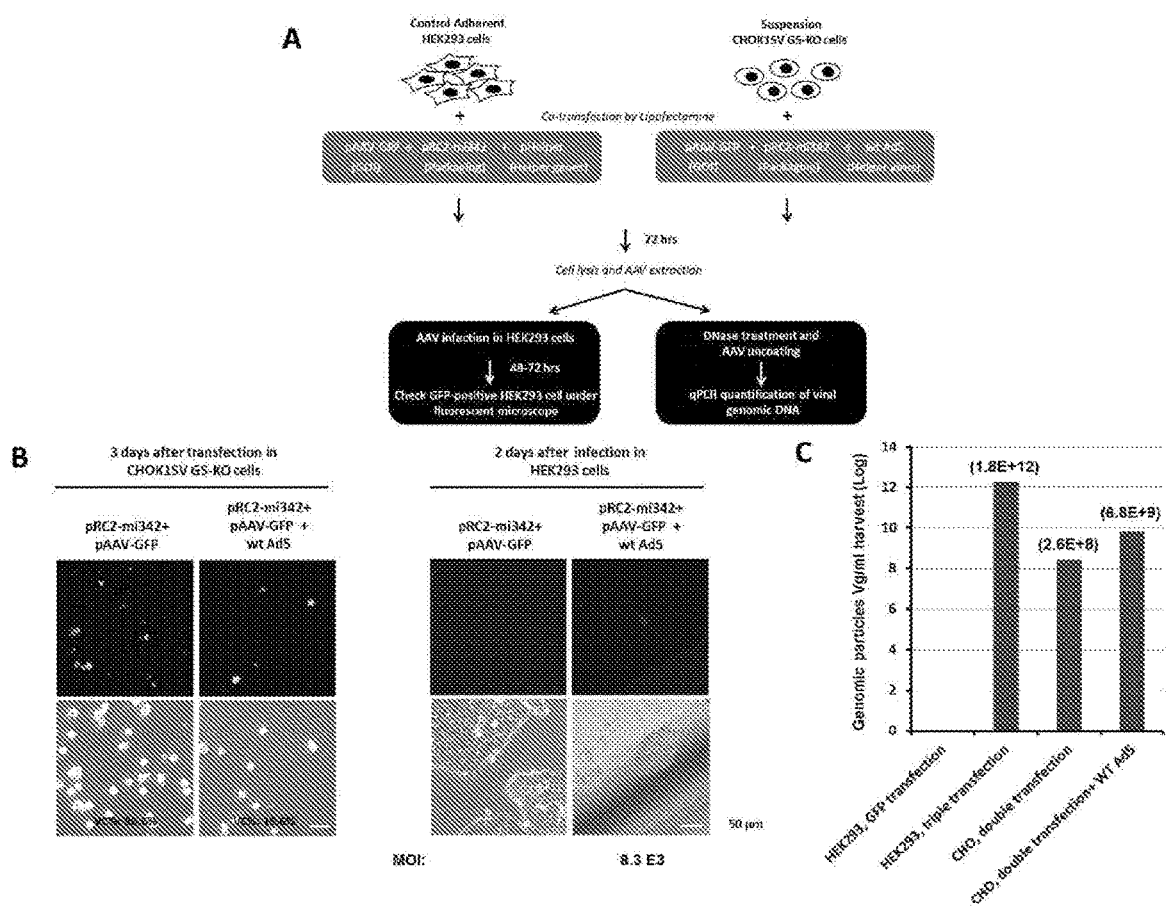
FIG. 1 shows the production of recombinant adeno-associated virus (rAAV) in HEK293 and CHOK1SV GS-KO™ cells. In HEK293 cells plasmid triple transfection was completed (pAAV-GFP (AAV-400, Cell Biolabs), pRC2-mi342 (6234, Clontech) and pHelper (6234, Clontech)). In CHOK1SV GS-KO™ a double transfection was completed (pAAV-GFP (AAV-400, Cell Biolabs) and pRC2-mi342 (6234, Clontech)) with helper virus co-infection (wt Ad5).

The use of the word "a" or "an" when used in conjunction with the term "comprising" in the claims and/or the specification may mean "one," but it is also consistent with the meaning of "one or more," "at least one," and "one or more than one."

Throughout this application, the term "about" is used to indicate that a value includes the inherent variation of error for the method/device being employed to determine the value, or the variation that exists among the study subjects. Typically the term is meant to encompass approximately or less than 1%, 2%, 3%, 4%, 5%, 6%, 7%, 8%, 9%, 10%, 11%, 12%, 13%, 14%, 15%, 16%, 17%, 18%, 19% or 20% variability depending on the situation.

The use of the term "or" in the claims is used to mean "and/or" unless explicitly indicated to refer only to alternatives or the alternatives are mutually exclusive, although the disclosure supports a definition that refers to only alternatives and "and/or."

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited, elements or method steps. It is contemplated that any embodiment discussed in this specification can be implemented with respect to any method, system, host cells, expression vectors, and/or composition of the invention. Furthermore, compositions, systems, cells, and/or vectors of the invention can be used to achieve any of the methods as described herein.

The use of the term "for example" and its corresponding abbreviation "e.g." (whether italicized or not) means that the specific terms recited are representative examples and embodiments of the disclosure that are not intended to be limited to the specific examples referenced or cited unless explicitly stated otherwise.

The present disclosure provides a mammalian cell comprising (i) at least four distinct recombination target sites (RTS), (ii) an adenovirus (Ad) gene comprising E1A, E1B or a combination thereof, and (iii) a promoter operatively linked to the Ad gene, wherein the RTS, the Ad gene, and the promoter are chromosomally-integrated.

A "nucleic acid," "nucleic acid molecule," or "oligonucleotide" means a polymeric compound comprising covalently linked nucleotides. The term "nucleic acid" includes polyribonucleic acid (RNA) and polydeoxyribonucleic acid (DNA), both of which may be single- or double-stranded. DNA includes, but is not limited to, complimentary DNA (cDNA), genomic DNA, plasmid or vector DNA, and synthetic DNA. RNA includes, but is not limited to, mRNA, tRNA, rRNA, snRNA, microRNA, miRNA, or MIRNA.

The term "recombinant" when used in reference to a nucleic acid molecule, peptide, polypeptide, or protein means of, or resulting from, a new combination of genetic material that is not known to exist in nature. A recombinant molecule can be produced by any of the well-known techniques available in the field of recombinant technology, including, but not limited to, polymerase chain reaction (PCR), gene cutting (e.g., using restriction endonucleases), and solid state synthesis of nucleic acid molecules, peptides, or proteins. In some embodiments, "recombinant" refers to a viral vector or virus that is not known to exist in nature, e.g. a viral vector or virus that has one or more mutations, nucleic acid insertions, or heterologous genes in the viral vector or virus. In some embodiments, "recombinant" refers to a cell or host cell that is not known to exist in nature, e.g. a cell or host cell that has one or more mutations, nucleic acid insertions, or heterologous genes in the cell or host cell.

An "isolated" polypeptide, protein, peptide, or nucleic acid is a molecule that has been removed from its natural environment. It is also to be understood that "isolated" polypeptides, proteins, peptides, or nucleic acids may be formulated with excipients such as diluents or adjuvants and still be considered isolated.

The terms "sequence identity" or "% identity" in the context of nucleic acid sequences or amino acid sequences refers to the percentage of residues in the compared sequences that are the same when the sequences are aligned over a specified comparison window. A comparison window can be a segment of at least 10 to over 1000 residues in which the sequences can be aligned and compared. Methods of alignment for determination of sequence identity are well-known in the art can be performed using publicly available databases such as BLAST (blast.ncbi.nlm.nih.gov/Blast.cgi.).

In some embodiments, polypeptides or nucleic acid molecules have at least about 70%, at least about 75%, at least about 80%, at least about 85%, at least about 90%, at least about 95%, at least about 97%, at least about 98%, at least about 99% or about 100% sequence identity with a reference polypeptide or nucleic acid molecule, respectively (or a fragment of the reference polypeptide or nucleic acid molecule). In certain embodiments of the disclosure, polypeptides or nucleic acid molecules have at least 70%, at least 75%, at least 80%, at least 85%, at least 90%, at least 95%, at least 97%, at least 98%, or at least 99% or 100% sequence identity with a reference polypeptide or nucleic acid molecule, respectively (or a fragment of the reference polypeptide or nucleic acid molecule). In some embodiments, polypeptides or nucleic acid molecules have about 90%, 91%, 92%, 93%, 94%, 95%, 96%, 97%, 98%, 99%, 99.5% sequence identity with a reference polypeptide or nucleic acid molecule, respectively.

As used herein, "promoter," "promoter sequence," or "promoter region" refers to a DNA regulatory region/sequence capable of binding RNA polymerase and involved in initiating transcription of a downstream coding or noncoding sequence. In some examples of the present disclosure, the promoter sequence includes the transcription initiation site and extends upstream to include the minimum number of bases or elements necessary to initiate transcription at levels detectable above background. In some embodiments, the promoter sequence includes a transcription initiation site, as well as protein binding domains responsible for the binding of RNA polymerase. Eukaryotic promoters will often, but not always, contain "TATA" boxes and "CAT" boxes. Various promoters, including inducible promoters, may be used to drive the gene expression, e.g., in the host cell or vectors of the present disclosure. In some embodiments, the promoter is not a leaky promoter, i.e., the promoter is not constitutively expressing any one of the gene products as described herein.

As referred to herein, the term "mammalian cell" includes cells from any member of the order Mammalia, such as, for example, human cells, mouse cells, rat cells, monkey cells, hamster cells, and the like. In some embodiments, the cell is a mouse cell, a human cell, a Chinese hamster ovary (CHO) cell, a CHO-K1 cell, a CHO-DXB11 cell, a CHO-DG44 cell, a CHOK1SV™ cell including all variants (e.g. CHOK1SV POTELLIGEN®, Lonza, Slough, UK), a CHOK1SV GS-KO™ (XCEED®, Lonza, Slough, UK) cell including all variants, a HEK293 cell including adherent and suspension-adapted variants, a HeLa cell, or a HT1080 cell.

As referred to herein, the term "chromosomally-integrated" or "chromosomal integration" refers to the stable incorporation of a nucleic acid sequence into the chromosome of a host cell, e.g. a mammalian cell. i.e., a nucleic acid sequence that is chromosomally-integrated into the genomic DNA (gDNA) of a host cell, e.g. a mammalian cell. In some embodiments, a nucleic acid sequence that is chromosomally-integrated is stable. In some embodiments, a nucleic acid sequence that is chromosomally-integrated is not located on a plasmid or a vector. In some embodiments, a nucleic acid sequence that is chromosomally-integrated is not excised. In some embodiments, chromosomal integration is mediated by the clustered regularly interspaced short palindromic repeats (CRISPR) and CRISPR associated protein (Cas) gene editing system (CRISPR/CAS).

The terms "recombination target site-specific integration" or "site-specific integration" as used herein are interchangeable and can be used to introduce one or more genes into a host cell chromosome. See, e.g., Bode et al., *Biol. Chem.* 381:801-813 (2000), Kolb, Cloning and Stem Cells 4:381-392 (2002) and Coates et al., *Trends in Biotech.* 23:407-419 (2005), each of which is incorporated by reference. In some embodiments, "recombination target site-specific integration" or "site-specific integration" refers to integration of a nucleic acid sequence into a chromosome at a specific site. In some embodiments, site-specific integration is through site-specific recombination. In some embodiments, "site-specific recombination" refers to the rearrangement of two DNA partner molecules by specific enzymes performing recombination at their cognate pairs of sequences or target sites. Site-specific recombination and site-specific integration, in contrast to homologous recombination, require very little DNA homology between partner DNA molecules, is RecA-independent, and does not involve DNA replication at any stage. In some embodiments, site specific recombination uses a site-specific recombinase system to achieve site-specific integration of nucleic acids in host cells, e.g. mammalian cells. A recombinase system typically consists of three elements: two specific DNA sequences (recombination target sites) and a specific enzyme (recombinase). The recombinase catalyzes a recombination reaction between the specific recombination target sites.

Other means known to those in the art can be used to insert one or more of the desired nucleic acid sequences (e.g., genes). In some embodiments, one or more nucleic acid sequences (e.g., genes) are inserted into a chromosome using homologous recombination. Homologous recombination refers to refers genetic recombination in which nucleotide sequences are exchanged between two similar or identical molecules of DNA. In some embodiments, the region targeted for deletion/insertion (e.g., a gene) is deleted/inserted by homologous recombination. For example, a DNA construct comprising an incoming sequence having a selective marker flanked on each side by sequences that are homologous to the region targeted for deletion/insertion is used. The DNA construct can align with the homologous sequences of the host chromosome and in a double crossover event the region targeted for (i) deletion is excised out of the host chromosome, or (ii) insertion is added into the chromosome. In some embodiments, homologous recombination is not used to insert a recombination target site, an adenovirus (Ad) gene e.g., E1A, E1B, E2A, E4, VA, MIR342, or combination thereof, and/or a promoter operatively linked to the Ad gene.

A recombinase enzyme, or recombinase, is a specific enzyme that catalyzes recombination in site-specific recombination. In some embodiments of the disclosure, the recombinase used for site-specific recombination is derived from a non-mammalian system. In some embodiments, the recombinase is derived from bacteria, bacteriophage, or yeast.

In some embodiments, a nucleic acid sequence encoding a recombinase is integrated into the host cell, e.g. mammalian cell. In some embodiments, a nucleic acid sequence encoding a recombinase is delivered to the host cell by other methods known to molecular biology. In some embodiments, a recombinase polypeptide sequence can be delivered to the cell directly. In some embodiments, the recombinase is a Cre recombinase, a Dre recombinase, a KD recombinase, a B2B3 recombinase, a Hin recombinase, a Tre recombinase, a λ integrase, a HK022 integrase, a HP1 integrase, a γδ resolvase/invertase, a ParA resolvase/invertase, a Tn3 resolvase/invertase, a Gin resolvase/invertase, a φC31 integrase, a BxB1 integrase, a R4 integrase or another functional recombinase enzyme. See, e.g., Thorpe & Smith, *Proc. Nat'l. Acad. Sci. USA* 95: 5505-5510 (1998); Kuhstoss & Rao, *J. Mol. Biol.* 222: 897-890 (1991); U.S. Pat. No. 5,190,871; Ow & Ausubel, *J. Bacteriol.* 155: 704-713 (1983); Matsuura et al., *J. Bacteriol.* 178: 3374-3376 (1996); Sato et al., *J. Bacteriol.* 172: 1092-1098 (1990); Stragier et al., *Science* 243: 507-512 (1989); Carrasco et al., *Genes Dev.* 8: 74-83 (1994); Bannam et al., *Mol. Microbiol.* 16: 535-551 (1995); Crelin & Rood, *J. Bacteriol.* 179: 5148-5156 (1997).

In some embodiments, a recombinase as described herein is a FLP recombinase. A FLP recombinase is a protein which catalyzes a site-specific recombination reaction that is involved in amplifying the copy number of the 2 µm plasmid of *Saccharomyces cerevisiae* during DNA replication. In some embodiments, the FLP recombinase of the present disclosure is derived from species of the genus *Saccharomyces*. In some embodiments, the FLP recombinase is derived from *Saccharomyces cerevisiae*. In some embodiments, the FLP recombinases is derived from a strain of *Saccharomyces cerevisiae*. In some embodiments, the FLP recombinase is a thermostable, mutant FLP recombinase. In some embodiments, the FLP recombinase is FLP1 or FLPe. In some embodiments, the nucleic acid sequence encoding the FLP recombinase comprises human optimized codons.

In some embodiments, the recombinase is a Cre recombinase. Cre (causes recombination) is a member of the Int family of recombinases (Argos et al. (1986) EMBO J. 5:433) and has been shown to perform efficient recombination of lox sites (locus of X-ing over) not only in bacteria but also in eukaryotic cells (Sauer (1987) Mol. Cell. Biol. 7:2087; Sauer and Henderson (1988) Proc. Natl Acad. Sci. 85:5166). In some embodiments, the Cre recombinase as described and used herein is derived from bacteriophage. In some embodiments, the Cre recombinase is derived from P1 bacteriophage.

As referred to herein, the terms "recombination target site," "RTS" and "site-specific recombinase target site" refer to a short, e.g. less than 60 base pairs, nucleic acid site or sequence which is recognized by a site-specific recombinase and which become the crossover regions during the site-specific recombination event. The acronym "RTS" can refer to a single recombination target site, or plural recombination target sites. In some embodiments, the RTS is less than about 60 base pairs, less than about 55 base pairs, less than about 50 base pairs, less than about 45 base pairs, less than about 40 base pairs, less than about 35 base pairs, or less than about 30 base pairs. In some embodiments, the RTS is about 30 to about 60 base pairs, about 30 to about 55 base pairs, about 32 to about 52 base pairs, about 34 to about 44 base pairs, about 32 base pairs, about 34 base pairs, or about 52 base pairs. Examples of RTS include, but are not limited to, lox sites, rox sites, Frt sites, att sites and dif sites. In some embodiments, RTS are nucleic acids having substantially the same sequence as set forth in any of the sequences in Tables 1, 2, 3 or 4.

In some embodiments, the RTS is a lox site selected from Table 1. As referred to herein, the term "lox site" refers to a nucleotide sequence at which a Cre recombinase can catalyze a site-specific recombination. A variety of non-identical lox sites are known to the art. The sequences of the various lox sites are similar in that they all contain identical 13-base pair inverted repeats flanking an 8-base pair asymmetric core region in which the recombination occurs. It is the asymmetric core region that is responsible for the directionality of the site and for the variation among the different lox sites. Illustrative (non-limiting) examples of these include the naturally occurring loxP (the sequence found in the P1 genome), loxB, loxL and loxR (these are found in the *E. coli* chromosome) as well as several mutant or variant lox sites such as loxP511, loxΔ86, loxΔ117, loxC2, loxP2, loxP3, loxP23, loxC2, loxP2, and loxP3. In some embodiments, the RTS is a lox site selected from loxΔ86, loxΔ117, loxC2, loxP2, loxP3 and loxP23. In some embodiments, a lox RTS is a nucleic acid having at least 90%, 91%, 92%, 93%, 94%, 95%, 96%, 97%, 98%, 99%, or 100% sequence identity to the sequences found in Table 1.

TABLE 1

| Name | Identifier | Sequence |
| --- | --- | --- |
| loxP | SEQ ID NO.: 1 | ATAACTTCGTATAATGT ATGCTATACGAAGTTAT |
| loxP511 | SEQ ID NO.: 2 | ATAACTTCGTATAATGT ATACTATACGAAGTTAT |
| loxP2272 | SEQ ID NO.: 3 | ATAACTTCGTATAAAGT ATCCTATACGAAGTTAT |
| loxP5171 | SEQ ID NO.: 4 | ATAACTTCGTATAATGT GTACTATACGAAGTTAT |
| loxP2272(V) | SEQ ID NO.: 5 | ATAACTTCGTATAGGAT ACTTTATACGAAGTTAT |
| pLox2+ | SEQ ID NO.: 6 | ATAACTTCGTATAATGT ATGCTATACGAAGTTAT |
| loxC2 | SEQ ID NO.: 28 | ACAACTTCGTATAATGT ATGCTATACGAAGTTAT |
| loxP2 | SEQ ID NO.: 29 | TACCGTTCGTATAGTAT AGTATATACGAAGTTAT |
| loxP3 | SEQ ID NO.: 30 | TACCGTTCGTATAGTAT AGTATATACGAACGGTA |

In some embodiments, the RTS is a Frt site selected from Table 2. As referred to herein, the term "Frt site" refers to a nucleotide sequence at which the product of the FLP gene of the yeast 2 µm plasmid, FLP recombinase, can catalyze a site-specific recombination. A variety of non-identical Frt sites are known to the art. The sequences of the various Frt sites are similar in that they all contain identical 13-base pair inverted repeats flanking an 8-base pair asymmetric core region in which the recombination occurs. It is the asymmetric core region that is responsible for the directionality of the site and for the variation among the different Frt sites. Illustrative (non-limiting) examples of these include the naturally occurring Frt, and several mutant or variant Frt sites such as Frt1, Frt2. In some embodiments, the RTS is a Frt site selected from Frt (F), Frt F1 (F1), Frt F2 (F2), Frt F3 (F3), Frt F4 (F4) or Frt F5 (F5). In some embodiments, the RTS is a Frt site selected from Frt F6 (F6), Frt F7 (F7), Frt F14 (F14), Frt F15 (F15) or Ff61. In some embodiments, the RTS is a Frt site selected from F2151, Fw2, F2161 and F2262. In some embodiments, the Frt recombination target site is a nucleic acid having at least 90%, 91%, 92%, 93%, 94%, 95%, 96%, 97%, 98%, 99%, or 100% sequence identity to the sequences found in Table 2.

TABLE 2

| Name | Identifier | Sequence |
| --- | --- | --- |
| F | SEQ ID NO.: 7 | GAAGTTACTATTCCGAAGTTCCTA TTCTCTAGAAAGTATAGGAACTTC |
| F1 | SEQ ID NO.: 8 | GAAGTTACTATTCCGAAGTTCCTA TTCTCTAGATAGTATAGGAACTTC |

TABLE 2-continued

| Name | Identifier | Sequence |
| --- | --- | --- |
| F2 | SEQ ID NO.: 9 | GAAGTTACTATTCCGAAGTTCCTATTCTCTACTTAGTATAGGAACTTC |
| F3 | SEQ ID NO.: 10 | GAAGTTACTATTCCGAAGTTCCTATTCTTCAAATAGTATAGGAACTTC |
| F4 | SEQ ID NO.: 11 | GAAGTTACTATTCCGAAGTTCCTATTCTCTAGAAGGTATAGGAACTTC |
| F5 | SEQ ID NO.: 12 | GAAGTTCCTATTCCGAAGTTCCTATTCTTCAAAAGGTATAGGAACTTC |
| F6 | SEQ ID NO.: 13 | GAAGTTCCTATTCCGAAGTTCCTATTCTTCAAAAAGTATAGGAACTTC |
| F7 | SEQ ID NO.: 14 | GAAGTTCCTATTCCGAAGTTCCTATTCTTCAATAAGTATAGGAACTTC |
| F14 | SEQ ID NO.: 15 | GAAGTTCCTATTCCGAAGTTCCTATTCTATCAGAAGTATAGGAACTTC |
| F15 | SEQ ID NO.: 16 | GAAGTTCCTATTCCGAAGTTCCTATTCTTATAGGAGTATAGGAACTTC |
| Ff61 | SEQ ID NO.: 17 | GAAGTTACTATTCCGAAGTTCCTATACTTTCTGGAGAATAGGAACTTC |
| F2151 | SEQ ID NO.: 18 | GAAGTTACTATTCCGAAGTTCCTATACTCTCCAGAGAATAGGAACTTC |
| Fw2 | SEQ ID NO.: 19 | GAAGTTACTATTCCGAAGTTCCTATACTATCTACAGAATAGGAACTTC |
| F2161 | SEQ ID NO.: 20 | GAAGTTACTATTCCGAAGTTCCTATACTCTCTGGAGAATAGGAACTTC |
| F2262 | SEQ ID NO.: 21 | GAAGTTACTATTCCGAAGTTCCTATACTATCTTGAGAATAGGAACTTC |

In some embodiments, the RTS is a rox site selected from Table 3. As referred to herein, the term "rox site" refers to a nucleotide sequence at which a Dre recombinase can catalyze a site-specific recombination. A variety of non-identical rox sites are known to the art. Illustrative (non-limiting) examples of these include roxR and roxF. In some embodiments, a rox recombination target site is a nucleic acid having at least 90%, 91%, 92%, 93%, 94%, 95%, 96%, 97%, 98%, 99%, or 100% sequence identity to the sequences found in Table 3.

TABLE 3

| Name | Identifier | Sequence |
| --- | --- | --- |
| roxF | SEQ ID NO.: 22 | TAACTTTAAATAATGCCAATTATTTAAAGTTA |
| roxR | SEQ ID NO.: 23 | TAACTTTAAATAATTGGCATTATTTAAAGTTA |

In some embodiments, the RTS is an att site selected from Table 4. As referred to herein, the term "att site" refers to a nucleotide sequence at which a λ integrase or φC31 integrase, can catalyze a site-specific recombination. A variety of non-identical aat sites are known to the art. Illustrative (non-limiting) examples of these include attP, attB, proB, trpC, galT, thrA, and rrnB. In some embodiments, an att recombination target site is a nucleic acid having at least 90%, 91%, 92%, 93%, 94%, 95%, 96%, 97%, 98%, 99%, or 100% sequence identity to the sequences found in Table 4.

TABLE 4

| Name | Identifier | Sequence |
| --- | --- | --- |
| attB | SEQ ID NO.: 24 | CATCAGGGCGGTCAGGCCGTAGATGTGGAAGAACGGCAGCACGGCGAGGACG |
| attP | SEQ ID NO.: 25 | ATGTGGTCCTTTAGATCCACTGACGTGGGTCAGTGTCTCTAAAGGACTCGCG |
| attL | SEQ ID NO.: 26 | CATCAGGGCGGTCAGGCCGTAGATGTGGGTCAGTGTCTCTAAAGGACTCGCG |
| attR | SEQ ID NO.: 27 | ATGTGGTCCTTTAGATCCACTGACGTGGAAGAACGGCAGCACGGCGAGGACG |

As referred to herein, the term "distinct recombination target sites" refers to non-identical or hetero-specific recombination target sites. For example, several variant Frt sites exist, but recombination can usually occur only between two identical Frt sites. In some embodiments, distinct recombination target sites refer to non-identical recombination target sites from the same recombination system (e.g. LoxP and LoxR). In some embodiments, distinct recombination target sites refer to non-identical recombination target sites from different recombination systems (e.g. LoxP and Frt). In some embodiments, distinct recombination target sites refer to a combination of recombination target sites from the same recombination system and recombination target sites from different recombination systems (e.g. LoxP, LoxR, Frt, and Frt1).

Various combinations of RTS can be used. In some embodiments, the cell comprises four RTS. In some embodiments, the cell comprises six RTSs. In some embodiments, at least one RTS is selected from SEQ ID Nos.: 1-30. In some embodiments, at least one RTS is selected from SEQ ID Nos.: 1-6. In some embodiments, at least one RTS is selected from SEQ ID Nos.: 28-30. In some embodiments, at least one RTS is selected from SEQ ID Nos.: 7-21. In some embodiments, at least one RTS is selected from SEQ ID Nos.: 22-23. In some embodiments, at least one RTS is selected from SEQ ID Nos.: 24-27. In some embodiments, at least one RTS is selected from SEQ ID Nos.: 28-30. In some embodiments, the cell comprising at least four distinct RTS includes the following RTS: LoxP_511, Frt_F5, Frt, and LoxP. In some embodiments, the cell comprising at least four distinct RTS includes the following RTS: Frt_F14 and Frt_F15. In some embodiments, the cell comprising at least four distinct RTS includes the following RTS: LoxP_511, Frt_F5, Frt, LoxP, Frt_F14 and Frt_F15. In some embodiments, the cell comprising at least four distinct RTS can include the following RTS: Frt_1, Frt_2, Frt_3, Frt_4. In some embodiments, the cell comprising at least four distinct RTS includes the following RTS: Frt_m5, Frt_wt, Frt_m14, Frt_m15, Frt_m7 and Frt_m6.

As referred to herein, the term "landing pad" refers to a nucleic acid sequence comprising a first recombination target site chromosomally-integrated into a host cell. In some embodiments, a landing site comprises two or more recombination target sites chromosomally-integrated into a host cell. In some embodiments, the cell comprises 1, 2, 3, 4, 5, 6, 7, or 8 landing pads. In some embodiments, landing pads are integrated at up to 1, 2, 3, 4, 5, 6, 7, or 8 distinct chromosomal loci.

As referred to herein, the term "adenovirus" refers to a non-enveloped virus with an icosahedral nucleocapsid containing a double stranded DNA of the family Adenoviridae. Over 50 adenoviral subtypes have been isolated from humans and many additional subtypes have been isolated from other mammals and birds. Birds. See, e.g., Ishibashi et al., "Adenoviruses of animals," In *The Adenoviruses*, Ginsberg, ed., Plenum Press, New York, N.Y., pp. 497-562 (1984); Strauss, "Adenovirus infections in humans," In *The Adenoviruses*, Ginsberg, ed., Plenum Press, New York, N.Y., pp. 451-596 (1984). These subtypes belong to the family Adenoviridae, which is currently divided into two genera, namely Mastadenovirus and Aviadenovirus. All adenoviruses are morphologically and structurally similar. In humans, however, adenoviruses show diverging immunological properties and are, therefore, divided into serotypes. Two human serotypes of adenovirus, namely Ad2 and Ad5, have been studied intensively and have provided the majority of general information about adenoviruses.

A "gene" refers to an assembly of nucleotides that encode a polypeptide, and includes cDNA and genomic DNA nucleic acid molecules. "Gene" also refers to a nucleic acid fragment that can act as a regulatory sequence preceding (5' non-coding sequences) and following (3' non-coding sequences) the coding sequence. In some embodiments, genes are integrated with multiple copies. In some embodiments, genes are integrated at predefined copy numbers.

As referred to herein, the term "adenovirus gene" or "AV gene" refers to a gene that is composed of one or more nucleic acid sequences derived from one or more adenovirus subtypes or serotypes. In some embodiments, the Ad gene is a gene that contributes to Adeno-associated virus replication and packaging. In some embodiments, the Ad gene is E1A, E1B, E2A, E4, VA, MIR342, or a combination thereof or any other Ad gene. In some embodiments, the disclosure provides for a cell in which one or more of Ad genes is chromosomally-integrated into the cell. In some embodiments, the disclosure provides for a cell in which one or more of E1A, E1B, E2A, E4, VA, MIR342 is chromosomally-integrated into the cell. In some embodiments, the Ad gene comprises E1A. In some embodiments, the Ad gene comprises E1A and E1B. In some embodiments, the Ad gene comprises E1A, E1B, and E2A. In some embodiments, the Ad gene comprises E1A, E1B, E2A, and E4. In some embodiments, the Ad gene comprises E1A, E1B, E2A, E4, and VA. In some embodiments, the Ad gene comprises E1A, E1B, E2A, E4, VA, and MIR342. In some embodiments, the Ad gene comprises E1A and E2A. In some embodiments, the Ad gene comprises E1A, E2A, and E4. In some embodiments, the Ad gene comprises E1A, E2A, E4, and VA. In some embodiments, the Ad gene comprises E1A, E2A, E4, VA, and MIR342. In some embodiments, the Ad gene comprises E1A and E4. In some embodiments, the Ad gene comprises E1A, E4, and VA. In some embodiments, the Ad gene comprises E1A, E4, VA, and MIR342. In some embodiments, the Ad gene comprises E1A and VA. In some embodiments, the Ad gene comprises E1A, VA, and MIR342. In some embodiments, the Ad gene comprises E1A and M1R342. In some embodiments, the Ad gene comprises E1B. In some embodiments, the Ad gene comprises E1B and E2A. In some embodiments, the Ad gene comprises E1B, E2A, and E4. In some embodiments, the Ad gene comprises E1B, E2A, E4, and VA. In some embodiments, the Ad gene comprises E1B, E2A, E4, VA and MIR342. In some embodiments, the Ad gene comprises E1B, and E4. In some embodiments, the Ad gene comprises E1B, E4, and VA. In some embodiments, the Ad gene comprises E1B, E4, VA, and MIR342. In some embodiments, the Ad gene comprises E1B and VA. In some embodiments, the Ad gene comprises E1B, VA, and MIR342. In some embodiments, the Ad gene comprises E1B, and MR342. In some embodiments, the Ad gene comprises E2A. In some embodiments, the Ad gene comprises E2A and E4. In some embodiments, the Ad gene comprises E2A, E4, and VA. In some embodiments, the Ad gene comprises E2A, E4, VA, and M1R342. In some embodiments, the Ad gene comprises E2A and VA. In some embodiments, the Ad gene comprises E2A, VA, and MIR342. In some embodiments, the Ad gene comprises E2A and MIR342. In some embodiments, the Ad gene comprises E4. In some embodiments, the Ad gene comprises E4 and VA. In some embodiments, the Ad gene comprises E4, VA, and M1R342. In some embodiments, the Ad gene comprises E4 and M1R342. In some embodiments, the Ad gene comprises VA. In some embodiments, the Ad gene comprises VA and MIR342. In some embodiments, the Ad gene comprises MIR342. In some embodiments, the inventors find that when the Ad gene comprises E1A, E1B, E2A, E4, VA, and MIR342 wherein the Ad gene is chromosomally-integrated, more consistent Ad gene expression is observed. In some embodiments, the Ad gene comprises one or more selected from E1A, E1B, E2A, E4, VA, and MIR342.

As referred to herein, the term "regulatory element" refers to a genetic element which controls some aspect of the expression of nucleic acid sequences. As used herein, a "promoter" is a regulatory element which facilitates the initiation of transcription of an operably linked coding region. In some embodiments, a promoter is an Ad promoter. As used herein, the term "AV promoter" refers to such a regulatory element which is derived from an adenovirus system. In some embodiments, a promoter is an AAV promoter. As used herein, the term "AAV promoter" refers to such a regulatory element which is derived from an adeno-associated virus system. In some embodiments, the disclosure provides for a cell in which one or more AAV promoters are chromosomally-integrated into the cell. As used herein, the term "non-AV promoter" refers to such a regulatory element which is derived from a non-adenovirus system. In some embodiments, the non-AV promoter is derived from a prokaryotic system. In some embodiments, the non-AV promoter is derived from a eukaryotic system. In some embodiments, the disclosure provides for a cell in which one or more promoters are chromosomally-integrated into the cell. In some embodiments, the disclosure provides for a cell in which one or more of non-AV promoters are chromosomally-integrated into the cell. In some embodiments, the disclosure provides for a cell in which one or more of Ad promoters are chromosomally-integrated into the cell. In some embodiments, a promoter is a non-AAV promoter. As used herein, the term "non-AAV promoter" refers to such a regulatory element which is derived from a non adeno-associated virus system. In some embodiments, the non-AAV promoter is derived from a prokaryotic system. In some embodiments, the non-AAV promoter is derived from a eukaryotic system. In some embodiments, the disclosure provides for a cell in which one or more non-AAV promoters are chromosomally-integrated into the cell.

As referred to herein, the terms "in operable combination", "in operable order" and "operably linked" refer to the linkage of nucleic acid sequences in such a manner that a nucleic acid molecule capable of directing the transcription of a given gene and/or the synthesis of a desired protein molecule is produced. The term also refers to the linkage of amino acid sequences in such a manner so that a functional protein is produced. In some embodiments, an Ad gene is operably linked to a promoter, wherein the Ad gene is chromosomally-integrated into the host cell genome. In some embodiments, the Ad gene is operably linked to a non-Ad promoter, where in the Ad gene is chromosomally-integrated into the host cell genome. In some embodiments, the Ad gene is operably linked to an Ad promoter, wherein the Ad gene is chromosomally-integrated into the host cell genome. In some embodiments, an AAV gene is operably linked to a promoter, wherein the AAV gene is chromosomally-integrated into the host cell genome. In some embodiments, the AAV gene is operably linked to a non-AAV promoter, where in the AAV gene is chromosomally-integrated into the host cell genome. In some embodiments, the AAV gene is operably linked to an AAV promoter, where in the AAV gene is chromosomally-integrated into the host cell genome. In some embodiments, a GOI is operably linked to a promoter, wherein the GOI is chromosomally-integrated into the host cell genome. In some embodiments, the GOI gene is operably linked to a non-GOI promoter, wherein the GOI is chromosomally-integrated into the host cell genome. In some embodiments, a recombinase gene is operably linked to a promoter, wherein the recombinase gene is chromosomally-integrated into the host cell genome. In some embodiments, the recombinase gene is operably linked to a promoter, where in the recombinase gene is not integrated into the host cell genome. In some embodiments, a recombinase gene is operably linked to a promoter, wherein the recombinase gene is not chromosomally-integrated into the host cell genome. In some embodiments, the recombinase gene is operably linked to a promoter, where in the recombinase gene is not chromosomally-integrated into the host cell genome.

In some embodiments, regulatory elements operably link gene expression to the presence of an exogenously supplied ligand. In some embodiments, an Ad gene is operably linked to a promoter, wherein the promoter operably links gene expression to the presence of an exogenously supplied ligand and wherein the Ad gene is chromosomally-integrated into the host cell genome. In some embodiments, an AAV gene is operably linked to a promoter, wherein the promoter operably links gene expression to the presence of an exogenously supplied ligand and wherein the AAV gene is chromosomally-integrated into the host cell genome. In some embodiments, a GOI is operably linked to a promoter, wherein the promoter operably links gene expression to the presence of an exogenously supplied ligand and wherein the GOI is chromosomally-integrated into the host cell genome. In some embodiments, a recombinase gene is operably linked to a promoter, wherein the promoter operably links gene expression to the presence of an exogenously supplied ligand and wherein the recombinase gene is chromosomally-integrated into the host cell genome. In some embodiments, a recombinase gene is operably linked to a promoter, wherein the promoter operably links gene expression to the presence of an exogenously supplied ligand and wherein the recombinase gene is not chromosomally-integrated into the host cell genome. In some embodiments, E1A expression is operably linked to a promoter, wherein the promoter operably links gene expression to the production of rAAV. In some embodiments, E1A expression is operably linked to a promoter, wherein the promoter operably links gene expression to the presence of an exogenously supplied ligand and wherein gene expression operably links the present of the exogenously supplied ligand to the production of rAAV.

In some embodiments, at least one RTS, the Ad gene, and the promoter are integrated at a single chromosomal locus. In some embodiments, a first Ad gene E1A and E1B, and a second Ad gene comprising E2A, E4, VA and MIR342 are on two different loci. In some embodiments, a first Ad gene E1A and E1B, and a second Ad gene comprising E2A, E4, VA and MIR342 are on the same locus. In some embodiments, a first Ad gene E1A and E1B, and a second Ad gene comprising E2A, E4, VA and MIR342 are the same locus, and an adeno-associated virus (AAV) gene is on a different locus. In some embodiments, a first Ad gene E1A and E1B, and a second Ad gene comprising E2A, E4, VA and MIR342 are the same locus, and an adeno-associated virus (AAV) gene and an AAV vector cassette is on a different locus.

As referred to herein, the term "chromosomal locus" refers to a defined location of nucleic acids on the chromosome of the cell that may comprise at least one gene. In some embodiments, the chromosomal locus is about 500 base pairs to about 100,000 base pairs, about 5,000 base pairs to about 75,000 base pairs, about 5,000 base pairs to about 60,000 base pairs, about 20,000 base pairs to about 50,000 base pairs, about 30,000 base pairs to about 50,000 base pairs, or about 45,000 base pairs to about 49,000 base pairs. In some embodiments, the chromosomal locus extends up to about 100 base pairs, about 250 base pairs, about 500 base pairs, about 750 base pairs, or about 1000 base pairs to the 5' or the 3' end of the defined nucleic acid sequence. In some embodiments, the chromosomal locus comprises an endogenous nucleic acid sequence. In some embodiments, the chromosomal locus comprises an exogenous nucleotide sequence having been integrated into the chromosome using methods known to one of the art of molecular biology. In some embodiments, the chromosomal locus comprises a nucleotide sequence, in the genome of a host cell which provides for a strong and stable production of a protein encoded by a gene integrated within the chromosomal locus. In some embodiments, the chromosomal locus comprises a nucleotide sequence in the genome of a host cell which provides for a strong and stable viral gene expression. In some embodiments, the chromosomal locus comprises a nucleotide sequence in the genome of a host cell which provides efficient site specific recombination. In some embodiments, the chromosomal locus comprises Fer1L4 (see e.g. U.S. patent application Ser. No. 14/409,283), ROSA26, HGPRT, DHFR, COSMC, LDHA, or MGAT1. In some embodiments, the chromosomal locus comprises NL or NL2. In some embodiments, the chromosomal locus the first intron of MID1 on the X chromosome. In some embodiments, the chromosomal locus is an Enhanced Expression and Stability Region (Regeneron, Tarrytown, NY EESYRs, see, e.g., U.S. Pat. No. 7,771,997). In some embodiments, at least a portion of the nucleic acids in the chromosomal locus is deleted.

In some embodiments, the chromosomal locus comprises the NL1 locus, the NL2 locus, the NL3 locus, the NL4 locus, the NL5 locus, or the NL6 locus as described in Table A. In some embodiments, the disclosure is directed to a mammalian cell comprising at least two distinct recombination target sites (RTS) wherein at least one RTS, the Ad gene, and the promoter are integrated within the NL1 locus, the NL2 locus, the NL3 locus, the NL4 locus, the NL5 locus, or the NL6 locus. In some embodiments, a first Ad gene E1A and E1B, and a second Ad gene comprising E2A, E4, VA and MIR342 are on two different loci, one of which is within the NL1 locus, the NL2 locus, the NL3 locus, the NL4 locus, the NL5 locus, or the NL6 locus. In some embodiments, a first Ad gene E1A and E1B, and a second Ad gene comprising E2A, E4, VA and MIR342 are within the NL1 locus, the NL2 locus, the NL3 locus, the NL4 locus, the NL5 locus, or the NL6 locus. In some embodiments, a first Ad gene E1A and E1B, and a second Ad gene comprising E2A, E4, VA and M1R342 are within the NL1 locus, the NL2 locus, the NL3 locus, the NL4 locus, the NL5 locus, or the NL6 locus. In some embodiments, a first Ad gene E1A and E1B, and a second Ad gene comprising E2A, E4, VA and MIR342 are within the NL1 locus, the NL2 locus, the NL3 locus, the NL4 locus, the NL5 locus, or the NL6 locus. In some embodiments, the disclosure is directed to a mammalian cell comprising at least three distinct recombination target sites (RTS) wherein at least one RTS, the Ad gene, and the promoter are integrated within the NL1 locus, the NL2 locus, the NL3 locus, the NL4 locus, the NL5 locus, or the NL6 locus. In some embodiments, the disclosure is directed to a mammalian cell comprising at least four distinct recombination target sites (RTS) wherein at least one RTS, the Ad gene, and the promoter are integrated within the NL1 locus, the NL2 locus, the NL3 locus, the NL4 locus, the NL5 locus, or the NL6 locus. In some embodiments, the disclosure is directed to a mammalian cell comprising at least five distinct recombination target sites (RTS) wherein at least one RTS, the Ad gene, and the promoter are integrated within the NL1 locus, the NL2 locus, the NL3 locus, the NL4 locus, the NL5 locus, or the NL6 locus. In some embodiments, the disclosure is directed to a mammalian cell comprising at least six distinct recombination target sites (RTS) wherein at least one RTS, the Ad gene, and the promoter are integrated within the NL1 locus, the NL2 locus, the NL3 locus, the NL4 locus, the NL5 locus, or the NL6 locus.

50,000 bp, within about 40,000 bp, within about 30,000 bp, within 20,000 bp or within 10,000 bp of the indicated genomic coordinates.

In some embodiments, the cell comprises a site-specific recombinase gene. In some embodiments, the site-specific recombinase gene is chromosomally-integrated.

As referred to herein, the term "located between two of the RTS" refers to a gene located between two of the RTS, i.e., with one of the RTS located 5' of the gene and a different RTS located 3' of the gene. In some embodiments, the RTS are located directly adjacent to the gene located between them. In some embodiments, the RTS are located at a defined distance from the gene located between them. In some embodiments, the RTS are directional sequences. In some embodiments, the RTS 5' and 3' of the gene located between them are directly oriented (i.e. they are oriented in the same direction). In some embodiments, the RTS 5' and 3' of the gene located between them are inversely oriented (i.e. they are oriented in opposite directions).

In some embodiments, the cell further comprises an adeno-associated virus (AAV) gene, wherein the AAV gene is chromosomally-integrated. An AAV gene comprises any gene from any AAV serotype. In some embodiments, the AAV gene is Rep, Rep78, Rep68, Rep52, Rep40, Cap, VP1,

TABLE A

| New Loci | Loci Gene Annotation | | | Loci Location in *Cricetulus griseus* | | | Loci Location in *Homosapien* | | |
|---|---|---|---|---|---|---|---|---|---|
| | 5' gene | Within gene | 3' gene | NCBI Reference Sequence (*Cricetulus griseus*) | Vector Location | Landing Pad Location | Chromosome | Vector Location | Landing Pad Location |
| Fer1 | Ergic3 | Fer1L4 | Spag4 | gi\|351517716\|ref\|NW_003613833\|Scaffold 1492 SEQ ID NO: 31 | N/A | 24894-26755 | Chr 20 | 33613757-33614117 | 33630003-33629572 |
| NL1 | Col5a2 (pseudo) | No annotated gene | Col5a2 | gi\|351515650\|ref\|NW_003615899.1\|Scaffold 2552 SEQ ID NO: 32 | 143287 | 133598 | Chr 2 | 189725696-189726735 | 189725180-189727852 |
| NL2 | LOC103162114 | Naa15 (Intron between Exon 5 & 6) | Rab33b | gi\|351517715\|ref\|NW_003613834.1\|Scaffold2422 SEQ ID NO: 33 | 1303708 to 1308873 | 1313999 | Chr 4 | 140474660-140474867 | 140483934-140483457 |
| NL3 | CJO004127.1 | No annotated gene | Mthfd2 | gi\|351516540\|ref\|NW_003615009.1\|Scaffold3922 SEQ ID NO: 34 | 279558 | N/A | Chr 2 | 74277198-74297932 | N/A |
| NL4 | MORF4L1 | No annotated gene | No annotated gene | gi\|351516248\|ref\|NW_003615301.1\|Scaffold502 SEQ ID NO: 35 | 173850 | N/A | Chr 15 | 76952458 | N/A |
| NL5 | ZNHIT1 | No annotated gene | Tatc1 | gi\|351517397\|ref\|NW_003614152.1\|Scaffold3667 SEQ ID NO: 36 | 779010 | N/A | Chr 7 | 100648176-100653983 | N/A |
| NL6 | Arhgef28 | Utp15 | Ankra | gi\|351516957\|ref\|NW_003614592.1\|Scaffold7019 SEQ ID NO: 37 | 225021 | N/A | Chr 5 | 73084488-73084783 | N/A |

One of skill in the art will recognize that the term "integrated within the NL1 locus" or "integrated within the NL2 locus" will include integration into any part of the locus, and it not limited to just the indicated genomic coordinates. One of skill in the art will recognize that the term "integrated within the NL1 locus" or "integrated within the NL2 locus" would also include corresponding loci in corresponding organisms. Thus, in some embodiments, the term "integrated within the NL1 locus" or "integrated within the NL2 locus" will include an integration within about VP2, VP3, or a combination thereof. In some embodiments, the AAV gene is from adeno-associated virus type 2. In some embodiments, the AAV gene is from the adeno-associated virus Anc80. In some embodiments, the AAV gene comprises the ANC80 Rep and Cap genes. In some embodiments, the AAV gene is located between two of the RTS.

As referred to herein, the term "adeno-associated virus (AAV)" refers to a small sized, replicative-defective nonenveloped virus containing a single stranded DNA of the family Parvoviridae and the genus Dependoparvovirus.

Over 10 adeno-associated virus serotypes have been identified so far, with serotype AAV2 being the best characterized. Other (non-limiting) examples of AAV serotypes are ANC80, AAV1, AAV3, AAV4, AAV5, AAV6, AAV7, AAV8, AAV9, AAV10, and AAV11. In addition to these serotypes, AAV pseudotypes have been developed. An AAV pseudotype contains the capsid of a first serotype and the genome of a second serotype (e.g. the pseudotype AAV2/5 would correspond to an AAV with the genome of serotype AAV2 and the capsid of AAV5).

As used herein, the term "recombinant AAV" or "rAAV" is defined as an infectious, replication-defective virus composed of an AAV protein shell encapsidating (i.e., surrounding with a protein coat) a heterologous gene, which in turn is flanked 5' and 3' by AAV ITRs.

As used herein, the term replication competent adenovirus (RCA) refers to undesired contaminants of active adenovirus particles sometimes produced during rAAV production generated by homologous recombination between a recombinant adenovirus vector and the adenovirus genes present in the producer cell genome.

As referred to herein, the term "adeno-associated virus gene" refers to a gene that is composed of one or more nucleic acid sequences derived from one or more adeno-associated virus serotypes. In some embodiments, the AAV gene comprises a gene that contributes to AAV replication and packaging.

As referred to herein, the term "Rep" gene is meant the art-recognized region of the AAV genome which encodes the replication proteins of the virus which are collectively required for replicating the viral genome, or functional homologues thereof such as the human herpesvirus 6 (HHV-6) rep gene which is also known to mediate AAV-2 DNA replication. Thus, the rep coding region includes at least the genes encoding for AAV Rep78 and Rep68 (the "long forms of Rep"), and Rep52 and Rep40 (the "short forms of Rep"), or functional homologues thereof. For a further description of the AAV rep coding region. The rep coding region, as used herein, can be derived from any viral serotype, such as the AAV serotypes described above. The region need not include all wild-type genes but may be altered, (e.g., by insertion, deletion or substitution of nucleotides), so long as the rep genes present provide for sufficient integration functions when expressed in a suitable target cell. See, e.g. Muzyczka, N., *Current Topics in Microbiol. and Immunol.* 158:97-129 (1992); and Kotin, R. M., *Human Gene Therapy* 5:793-801 (1994).

As referred to herein, the term "Cap" gene refers to the art-recognized region of the AAV genome which encodes the capsid proteins of the virus. Illustrative (non-limiting) examples of these capsid proteins are the AAV capsid proteins VP1, VP2, and VP3. Cap genes used in this disclosure can come from any AAV serotype or a combination of AAV serotypes.

In some embodiments, the cell comprises a second Ad gene, wherein the second Ad gene is chromosomally-integrated. In some embodiments, the second Ad gene is E1A, E1B, E2A, E4, VA, MIR342, or a combination thereof. In some embodiments, the second Ad gene is from Ad5. In some embodiments, the second Ad gene is located between two of the RTS.

In some embodiments, the cell further comprises an AAV vector cassette, wherein the AAV vector cassette is chromosomally-integrated. In some embodiments, the AAV vector cassette is located between two of the RTS.

A "vector" or "expression vector" is a replicon, such as a plasmid, phage, virus, or cosmid, to which another DNA segment may be attached to bring about the replication and/or expression of the attached DNA segment in a cell. "Vector" includes episomal (e.g., plasmids) and non episomal vectors. In some embodiments of the present disclosure the vector is an episomal vector, which is removed/lost from a population of cells after a number of cellular generations, e.g., by asymmetric partitioning. The term "vector" includes both viral and non-viral means for introducing a nucleic acid molecule into a cell in vitro, in vivo, or ex vivo. The term vector may include synthetic vectors. Vectors may be introduced into the desired host cells by well-known methods, including, but not limited to, transfection, transduction, cell fusion, and lipofection. Vectors can comprise various regulatory elements including promoters.

"Transfection" as used herein means the introduction of an exogenous nucleic acid molecule, including a vector, into a cell. A "transfected" cell comprises an exogenous nucleic acid molecule inside the cell and a "transformed" cell is one in which the exogenous nucleic acid molecule within the cell induces a phenotypic change in the cell. The transfected nucleic acid molecule can be integrated into the host cell's genomic DNA and/or can be maintained by the cell, temporarily or for a prolonged period of time, extra-chromosomally. Host cells or organisms that express exogenous nucleic acid molecules or fragments are referred to as "recombinant," "transformed," or "transgenic" organisms. A number of transfection techniques are generally known in the art. See, e.g., Graham et al., *Virology*, 52:456 (1973); Sambrook et al., Molecular Cloning, a laboratory manual, Cold Spring Harbor Laboratories, New York (1989); Davis et al., Basic Methods in Molecular Biology, Elsevier (1986); and Chu et al., *Gene* 13:197 (1981). Such techniques can be used to introduce one or more exogenous DNA moieties, such as an AAV vector cassette, AAV helper constructs, and other nucleic acid molecules, into suitable host cells.

As used herein, the term "exchangeable cassette" or "cassette" is a type of mobile genetic element that contains a gene and a recombination site. In some embodiments, the exchangeable cassette comprises at least two RTS. In some embodiments, the exchangeable cassette comprises a reporter gene or a selection gene. In some embodiments, a cassette is exchanged through recombinase-mediated cassette-exchange (RMCE).

As referred to herein, the term "AAV vector cassette" refers to a cassette derived from an adeno-associated virus serotype vector. An AAV vector cassette can have one or more of the AAV wild-type genes deleted in whole or in part, e.g. the Rep and/or Cap genes, but retain functional flanking inverted terminal repeat (ITR) sequences.

As referred to herein, the term "functional flanking inverted terminal repeat" or "functional flaking ITR" sequences refer to the 145 base pair ITRs, the first 125 base pairs of which are capable of forming Y or T shaped duplex structures that are positioned at the 5' and 3' end of a gene of interest (GOI) in an AAV vector cassette. ITR sequences represent the minimal sequence required for replication, rescue, packaging and integration of the AAV genome.

As referred to herein, the terms "ancillary gene," "helper gene" and "ancillary helper gene" are used interchangeable to refer to a first gene that aids in the replication or packaging of rAAV. In some embodiments, the helper gene comprises a viral gene. In some embodiments, the helper gene comprises an Ad gene. In some embodiments, the helper gene comprises an AAV gene. In some embodiments, the helper gene comprises the AAV gene rep, cap or a combination thereof. In some embodiments, the helper gene comprises a prokaryotic gene. In some embodiments, the helper gene comprises a eukaryotic gene. In some embodiments, the helper gene comprises a gene encoding an RNA. In some embodiments, the helper gene comprises an interferon (IFN) antagonist. In some embodiments, the helper gene encodes a protein that is a Protein Kinase R (PKR) inhibitor. In some embodiments, the helper gene comprises a gene encoding the influenza NS1 protein. In some embodiments, the helper gene comprises a gene encoding the Vaccinia virus E3L protein, see e.g. de Vries et al, *Gene Ther.* 15:545-52, (2008). In some embodiments, the helper gene encodes a virus-encoded soluble IFN-alpha/beta receptor decoys which counteract the IFN response in infected cells. In some embodiments, the helper gene encodes NS1, E3L, or similar proteins. In some embodiments, the helper gene encodes NS1, E3L or proteins with homologous sequences or motifs.

As referred to herein, the term "gene of interest" or "GOI" is used to describe a heterologous gene. As referred to herein, the term "heterologous gene" or "HG" as it relates to nucleic acid sequences such as a coding sequence or a control sequence, denotes a nucleic acid sequence, e.g. a gene, that is not normally joined together, and/or are not normally associated with a particular cell. In some embodiments, a heterologous gene is a construct where the coding sequence itself is not found in nature (e.g., synthetic sequences having codons different from the native gene). Allelic variation or naturally occurring mutational events do not give rise to heterologous DNA, as used herein.

In some embodiments, the gene of interest comprises a reporter gene, a selection gene, a gene of therapeutic interest, or a combination thereof.

As referred to here, a "reporter gene" is a gene whose expression confers a phenotype upon a cell that can be easily identified and measured. In some embodiments, the reporter gene comprises a fluorescent protein gene. In some embodiments, the reporter gene comprises a selection gene.

As referred to herein, the term "selection gene" refers to the use of a gene which encodes an enzymatic activity that confers the ability to grow in medium lacking what would otherwise be an essential nutrient; in addition, a selection gene may confer resistance to an antibiotic or drug upon the cell in which the selection gene is expressed. A selection gene may be used to confer a particular phenotype upon a host cell. When a host cell must express a selection gene to grow in selective medium, the gene is said to be a positive selection gene. A selection gene can also be used to select against host cells containing a particular gene; a selection gene used in this manner is referred to as a negative selection gene.

As referred to herein, the term "gene of therapeutic interest" refers to any functionally relevant nucleotide sequence. Thus, the gene of therapeutic interest of the present disclosure can comprise any desired gene that encodes a protein that is defective or missing from a target cell genome or that encodes a non-native protein having a desired biological or therapeutic effect (e.g., an antiviral function), or the sequence can correspond to a molecule having an antisense or ribozyme function. Representative (non-limiting) examples of suitable genes of therapeutic interest include those used for the treatment of inflammatory diseases, autoimmune, chronic and infectious diseases, including such disorders as AIDS, cancer, neurological diseases, cardiovascular disease, hypercholestemia; various blood disorders including various anemias, thalassemias and hemophilia; genetic defects such as cystic fibrosis, Gaucher's Disease, adenosine deaminase (ADA) deficiency, emphysema, etc. Several antisense oligonucleotides (e.g., short oligonucleotides complementary to sequences around the translational initiation site (AUG codon) of an mRNA) that are useful in antisense therapy for cancer and for viral diseases have been described in the art and are also examples of suitable genes of therapeutic interest.

In some embodiments, the cell is substantially free of helper virus. As referred to herein, a 'helper virus' is any non-AAV virus that is added to enable the replication and packaging of adeno-associated virus. Representative (non-limiting) examples of helper viruses are adenovirus and herpes virus. In some embodiments, the term substantially free of helper virus refers to a cell that has fewer than 100, fewer than 10, or fewer than 1 helper virus per cell. In some embodiments, the term substantially free of helper virus refers to a cell in which no helper viruses are present or to a population of cells in which no helper viruses are present using detection methods known to those skilled in the art. In some embodiments, no wild-type helper virus is in the cell. In some embodiments, the term wild-type virus refers to any complete-non-AAV virus that can replicate in the cell independently of any other virus.

In some embodiments, the present disclosure provides a mammalian cell comprising (i) at least four distinct recombination target sites (RTS), (ii) an adenovirus (Ad) gene E2A, E4, VA, M1R342 or a combination thereof; and (iii) a promoter operatively linked to the Ad gene, wherein the RTS, the Ad gene and the promoter are chromosomally-integrated. In some embodiments, the cell is a mouse cell, a human cell, a CHO cell, a CHO-K1 cell, a CHO-DXB11 cell, a CHO-DG44 cell, a CHOK1SV™ cell including all variants (e.g. CHOK1SV™ POTELLIGENT®), a CHOK1SV GS-KO™ cell including all variants (e.g. XCEED™), a HEK293 cell including adherent and suspension-adapted variants, a HeLa cell, or a HT1080 cell.

In some embodiments, the cell comprises four RTSs. In some embodiments, the cell comprises six RTSs. In some embodiments, at least one RTS is selected from SEQ ID NOs.: 1-30. In some embodiments, the RTS, the Ad gene, and the promoter are integrated at a single chromosomal locus. In some embodiments, the chromosomal locus is Fer1L4, ROSA26, HGPRT, DHFR, COSMC, LDHa, MGAT1, GRIK1, NL1, NL2, NL3, NL4, NL5, NL6, the first intron of MID1 on the X chromosome, or Enhanced Expression and stability regions (EESYRs). In some embodiments, the cell comprises a site-specific recombinase gene. In some embodiments, the site-specific recombinase gene is chromosomally-integrated. In some embodiments, the cell further comprises a second Ad gene, wherein the second Ad gene is chromosomally-integrated. In some embodiments, the second Ad gene comprises E1A, E1B, E2A, E4, VA, MIR342, or a combination thereof. In some embodiments, the second Ad gene is from Ad5. In some embodiments, the second Ad gene is located between two of the RTS. In some embodiments, the cell further comprises an adeno-associated virus (AAV) gene, wherein the AAV gene is chromosomally-integrated. In some embodiments, the AAV gene comprises Rep, Cap, or a combination thereof. In some embodiments, the AAV gene is from adeno-associated virus type 2. In some embodiments, the AAV gene is located between two of the RTS. In some embodiments, the cell further comprises an AAV vector cassette, wherein the AAV vector cassette is chromosomally-integrated. In some embodiments, the AAV vector cassette is a reporter gene, a selection gene, a gene of therapeutic interest or a combination thereof. In some embodiments, the AAV vector cassette is located between two of the RTS. In some embodiments, the cell is substantially free of helper virus.

In some embodiments, the present disclosure provides a mammalian cell comprising (i) at least four distinct recombination target sites (RTS); and (ii) and an adeno-associated virus (AAV) gene comprising Rep, Cap, or a combination thereof, wherein the RTS and the AAV gene are chromosomally-integrated. In some embodiments, the cell is a mouse cell, a human cell, a CHO cell, a CHO-K1 cell, a CHO-DXB11 cell, a CHO-DG44 cell, a CHOK1SV™ cell including all variants (e.g. CHOK1SV POTELLIGENT®), a CHOK1SV GS-KO™ cell including all variants, a HEK293 cell including adherent and suspension-adapted variants, a HeLa cell, or a HT1080 cell. In some embodiments, the cell comprises four RTS. In some embodiments, the cell comprises six RTS. In some embodiments, at least one RTS is selected from SEQ ID Nos.: 1-30. In some embodiments, the RTS and the AAV gene are integrated at a single chromosomal locus. In some embodiments, the chromosomal locus is Fer1L4, ROSA26, HGPRT, DHFR, COSMC, LDHa, MGAT1, GRIK1, NL1, NL2, the first intron of MID1 on the X chromosome, or Enhanced Expression and stability regions (EESYRs). In some embodiments, the cell comprises a site-specific recombinase gene. In some embodiments, the site-specific recombinase gene is chromosomally-integrated. In some embodiments, the cell further comprises an Ad gene and a promoter operatively linked to the Ad gene, whereby the Ad gene and the promoter are chromosomally-integrated. In some embodiments, the Ad gene comprises E1A, E1B, E2A, E4, VA, MIR342 or a combination thereof. In some embodiments, the Ad gene is from Ad5. In some embodiments, the AAV gene is located between two of the RTS. In some embodiments, the cell further comprises an AAV vector cassette. In some embodiments, the AAV vector cassette comprises a reporter gene, a selection gene, a gene of therapeutic interest or a combination thereof. In some embodiments, the gene of interest is located between two of the RTS. In some embodiments, the cell is substantially free of helper virus. In some embodiments, the cell is completely free of helper virus.

In some embodiments, the present disclosure provides a Chinese hamster ovary (CHO) cell comprising: six distinct recombination target sites (RTS) wherein at least one RTS is selected from SEQ ID NOs.:1-30; an adenovirus (Ad) gene comprising E1A and E1B; a promoter operatively linked to the Ad gene, wherein the RTS, the Ad gene and the promoter are chromosomally-integrated; a second Ad gene comprising E2A, E4, VA, and MIR342, wherein the second Ad gene is located between two of the RTS; an adeno-associated virus (AAV) gene comprising Rep and Cap, wherein the AAV gene is located between two RTS; and an AAV vector cassette comprising a reporter gene, a selection gene or a gene of therapeutic interest, wherein the AAV vector cassette is located between two RTS.

In some embodiments, the present disclosure provides a Chinese hamster ovary (CHO) cell comprising an adenovirus (Ad) gene comprising E1A and E1B and a promoter operatively linked to the Ad gene, a second Ad gene comprising E2A, E4, VA, and M1R342, an adeno-associated virus (AAV) gene comprising Rep and Cap, and an AAV vector cassette comprising a reporter gene, a selection gene, a gene of therapeutic interest or a combination thereof.

In some embodiments, the present disclosure provides a method for producing a recombinant adeno-associated virus (rAAV) producer cell comprising: providing a cell that comprises at least four distinct recombination target sites (RTS), an adenovirus (Ad) gene comprising E1A, E1B, or a combination thereof, and a promoter operatively linked to the Ad gene, wherein the RTS, the Ad gene and the promoter are chromosomally-integrated, transfection of the cell provided with a vector comprising an exchangeable cassette encoding an adeno-associated virus (AAV) gene, a second Ad gene, an AAV vector cassette, or a combination thereof, integrating the exchangeable cassette into the chromosome, and selecting rAAV producer cells with the exchangeable cassette integrated into the chromosome. In some embodiments, the transfection is with two vectors, the first vector comprising an exchangeable cassette comprising the second Ad gene and the AAV gene and the second vector comprising an exchangeable cassette comprising the AAV vector cassette. In some embodiments, the transfection is with two vectors, the first vector comprising an exchangeable cassette comprising the second Ad gene and the second vector comprising an exchangeable cassette comprising the AAV gene. In some embodiments, the transfection is with three vectors, the first vector comprising an exchangeable cassette comprising the second Ad gene, the second vector comprising an exchangeable cassette comprising the AAV gene, and the third vector comprising the exchangeable cassette comprising the AAV vector cassette. In some embodiments, each exchangeable cassette further comprises two RTS, matching two of the RTS of the cell. In some embodiments, the inventors find that the use of SSI eliminates the need to clone cells from those transfected, as the cells are homogenous in their genetic composition.

The term "matching" in reference to two RTS sequences refers to two sequences that have the ability to be bound by a recombinase and to affect a site-specific recombination between the two sequences. In some embodiments, an RTS of an exchangeable cassette matching an RTS of the cell refers to the RTS of the cassette having a sequence substantially identical to the RTS of the cell. In some embodiments, the exchangeable cassette contains a sequence substantially identical to one or two of the RTS chromosomally-integrated in the cell.

In some embodiments, the term integrating refers to the integration, e.g. insertion, of the exchangeable cassette into the chromosome. In some embodiments, integration is mediated by a site-specific recombinase.

In some embodiments, the term "selecting" refers to identifying cells containing a chromosomally-integrated marker. In some embodiments, selection is through the detection of the presence of a marker using methods known to those skilled in the art. In some embodiments, selection is through the detection of the absence of a marker using methods known to those skilled in the art.

In some embodiments, the second Ad gene comprises E1A, E1B, E2A, E4, VA, MIR342, or a combination thereof. In some embodiments, the AAV gene is Rep, Cap, or a combination thereof. In some embodiments, the AAV vector cassette comprises a reporter gene, a selection gene, a gene of therapeutic interest or a combination thereof.

In some embodiments, the present disclosure provides a method for producing recombinant adeno-associated virus (rAAV) comprising of (i) infecting a host cell with AAV, (ii) producing rAAV packaged with an AAV vector cassette, and (iii) purifying the packaged rAAV, wherein the host cell comprises: at least four distinct recombination target sites (RTS), an adenovirus (Ad) gene comprising E1A, E1B or a combination thereof, a promoter operatively linked to the Ad gene, wherein the RTS, the Ad gene and the promoter are chromosomally-integrated, a second Ad gene comprising E1A, E1B, E2A, E4, VA, MIR342, or a combination thereof, an adeno-associated virus (AAV) gene comprising Rep, Cap, or a combination thereof, and the AAV vector cassette comprising a reporter gene, a selection gene, a gene of therapeutic interest or a combination thereof. In some embodiments, no live wild-type helper virus is required for rAAV production and packaging. In some embodiments, expression of E1A is not required for rAAV production. In some embodiments, a minimum of $1.0 \times 10^9$ vg/mL active rAAV is obtained after purification. In some embodiments of the disclosure, rAAV is produced substantially free of replication competent adenovirus (RCA). E.g., in some embodiments of the disclosure, RCA is below the limit of detection before purification. Methods of quantification of virus particles are known to those of skill in the art and can include quantitative polymerase chain reaction (qPCR) analysis, infection titration analysis, endpoint dilution assay, and viral plaque assay. In some embodiments, the inventors have found that the use of SSI to prepare rAAV producer cells ensures the pool of producer cells is homogenous in its genetic makeup. In some embodiments, the inventors have found that the use of SSI to prepare rAAV producer cells ensures the pool of producer cells is homogenous in its efficiency. In some embodiments, the inventors have found that the use of SSI to prepare rAAV producer cells ensures the pool of producer cells is homogenous in the ration of a first helper gene to a second helper gene. In some embodiments, the inventors have found that the use of SSI to prepare rAAV producer cells ensures the pool of producer cells is homogenous in the ratio of helper genes to genes of therapeutic interest. In some embodiments, the inventors have found that the use of SSI to prepare rAAV producer cells ensures more consistent rAAV product quality.

An "amino acid" as used herein refers to a compound containing both a carboxyl (—COOH) and amino (—NH$_2$) group. "Amino acid" refers to both natural and unnatural, i.e., synthetic, amino acids. Natural amino acids, with their three-letter and single letter abbreviations, include alanine (Ala; A); arginine (Arg, R); asparagine (Asn; N); aspartic acid (Asp; D); cysteine (Cys; C); glutamine (Gln; Q); glutamic acid (Glu; E); glycine (Gly; G); histidine (His; H); isoleucine (Ile; I); leucine (Leu; L); lysine (Lys; K); methionine (Met; M); phenylalanine (Phe; F); proline (Pro; P); serine (Ser; S); threonine (Thr; T); tryptophan (Trp; W); tyrosine (Tyr; Y); and valine (Val; V).

The terms "peptide," "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones.

The desired cell line including prokaryotic and/or eukaryotic cell lines can be cultured using any suitable device, facility and methods described herein. Further, in embodiments, the devices, facilities and methods are suitable for culturing suspension cells or anchorage-dependent (adherent) cells and are suitable for production operations configured for production of pharmaceutical and biopharmaceutical products—such as polypeptide products, nucleic acid products (for example DNA or RNA), or mammalian or microbial cells and/or viruses such as those used in cellular and/or viral and microbiota therapies.

In some embodiments, the cells express or produce a product, such as a recombinant therapeutic or diagnostic product. As described in more detail below, examples of products produced by cells include, but are not limited to, antibody molecules (e.g., monoclonal antibodies, bispecific antibodies), antibody mimetics (polypeptide molecules that bind specifically to antigens but that are not structurally related to antibodies such as e.g. DARPins, affibodies, adnectins, or IgNARs), fusion proteins (e.g., Fc fusion proteins, chimeric cytokines), other recombinant proteins (e.g., glycosylated proteins, enzymes, hormones), viral therapeutics (e.g., anti-cancer oncolytic viruses, viral vectors for gene therapy and viral immunotherapy), cell therapeutics (e.g., pluripotent stem cells, mesenchymal stem cells and adult stem cells), vaccines or lipid-encapsulated particles (e.g., exosomes, virus-like particles), RNA (such as e.g. siRNA) or DNA (such as e.g. plasmid DNA), antibiotics or amino acids. In embodiments, the devices, facilities and methods can be used for producing biosimilars.

As mentioned, in embodiments, devices, facilities and methods allow for the production of eukaryotic cells, e.g., mammalian cells or lower eukaryotic cells such as for example yeast cells or filamentous fungi cells, or prokaryotic cells such as Gram-positive or Gram-negative cells and/or products of the eukaryotic or prokaryotic cells, e.g., proteins, peptides, antibiotics, amino acids, nucleic acids (such as DNA or RNA), synthesized by the eukaryotic cells in a large-scale manner. In some embodiments, also disclosed are the use of microbial organisms and spores thereof utilized in microbiota therapeutics. Unless stated otherwise herein, the devices, facilities, and methods can include any desired volume or production capacity including but not limited to bench-scale, pilot-scale, and full production scale capacities.

Moreover and unless stated otherwise herein, the devices, facilities, and methods can include any suitable reactor(s) including but not limited to stirred tank, airlift, fiber, microfiber, hollow fiber, ceramic matrix, fluidized bed, fixed bed, and/or spouted bed bioreactors. As used herein, "reactor" can include a fermenter or fermentation unit, or any other reaction vessel and the term "reactor" is used interchangeably with "fermenter." The term fermenter or fermentation refers to both microbial and mammalian cultures. For example, in some aspects, an example bioreactor unit can perform one or more, or all, of the following: feeding of nutrients and/or carbon sources, injection of suitable gas (e.g., oxygen), inlet and outlet flow of fermentation or cell culture medium, separation of gas and liquid phases, maintenance of temperature, maintenance of oxygen and C02 levels, maintenance of pH level, agitation (e.g., stirring), and/or cleaning/sterilizing. Example reactor units, such as a fermentation unit, may contain multiple reactors within the unit, for example the unit can have 1, 2, 3, 4, 5, 10, 15, 20, 25, 30, 35, 40, 45, 50, 60, 70, 80, 90, or 100, or more bioreactors in each unit and/or a facility may contain multiple units having a single or multiple reactors within the facility. In various embodiments, the bioreactor can be suitable for batch, semi fed-batch, fed-batch, perfusion, and/or a continuous fermentation processes. Any suitable reactor diameter can be used. In embodiments, the bioreactor can have a volume between about 100 mL and about 50,000 L. Non-limiting examples include a volume of 100 mL, 250 mL, 500 mL, 750 mL, 1 liter, 2 liters, 3 liters, 4 liters, 5 liters, 6 liters, 7 liters, 8 liters, 9 liters, 10 liters, 15 liters, 20 liters, 25 liters, 30 liters, 40 liters, 50 liters, 60 liters, 70 liters, 80 liters, 90 liters, 100 liters, 150 liters, 200 liters, 250 liters, 300 liters, 350 liters, 400 liters, 450 liters, 500 liters, 550 liters, 600 liters, 650 liters, 700 liters, 750 liters, 800 liters, 850 liters, 900 liters, 950 liters, 1000 liters, 1500 liters, 2000 liters, 2500 liters, 3000 liters, 3500 liters, 4000 liters, 4500 liters, 5000 liters, 6000 liters, 7000 liters, 8000 liters, 9000 liters, 10,000 liters, 15,000 liters, 20,000 liters, and/or 50,000 liters. Additionally, suitable reactors can be multi-use, single-use, disposable, or non-disposable and can be formed of any suitable material including metal alloys such as stainless steel (e.g., 316L or any other suitable stainless steel) and Inconel, plastics, and/or glass.

In embodiments and unless stated otherwise herein, the devices, facilities, and methods described herein can also include any suitable unit operation and/or equipment not otherwise mentioned, such as operations and/or equipment for separation, purification, and isolation of such products. Any suitable facility and environment can be used, such as traditional stick-built facilities, modular, mobile and temporary facilities, or any other suitable construction, facility, and/or layout. For example, in some embodiments modular clean-rooms can be used. Additionally and unless otherwise stated, the devices, systems, and methods described herein can be housed and/or performed in a single location or facility or alternatively be housed and/or performed at separate or multiple locations and/or facilities.

By way of non-limiting examples and without limitation, U.S. Publication Nos. 2013/0280797; 2012/0077429; 2011/0280797; 2009/0305626; and U.S. Pat. Nos. 8,298,054; 7,629,167; and 5,656,491, which are hereby incorporated by reference in their entirety, describe example facilities, equipment, and/or systems that may be suitable.

In embodiments, the cells are eukaryotic cells, e.g., mammalian cells. The mammalian cells can be for example human or rodent or bovine cell lines or cell strains. Examples of such cells, cell lines or cell strains are e.g. mouse myeloma (NSO)-cell lines, Chinese hamster ovary (CHO)-cell lines, HT1080, H9, HepG2, MCF7, MDBK Jurkat, NIH3T3, PC12, BHK (baby hamster kidney cell), VERO, SP2/0, YB2/0, Y0, C127, L cell, COS, e.g., COS1 and COS7, QC1-3, HEK293, VERO, PER.C6, HeLa, EB1, EB2, EB3, oncolytic or hybridoma-cell lines. Preferably the mammalian cells are CHO cell lines. In one embodiment, the cell is a CHO cell. In one embodiment, the cell is a CHO-K1 cell, a CHOK1SV™ cell, a DG44 CHO cell, a DUXB11 CHO cell, a CHOS, a CHO GS knock-out cell, a CHO FUT8 GS knock-out cell, a CHOZN, or a CHO-derived cell. The CHO GS knock-out cell (e.g., GSKO cell) is, for example, a CHOK1SV GS-KO (part of Lonza's XCEED® Expression System, Lonza, Slough, UK). The CHO FUT8 knockout cell is, for example, the CHOK1SV™ POTELLIGENT® (Lonza, Slough, UK). Eukaryotic cells can also be avian cells, cell lines or cell strains, such as for example, EBX® cells, EB14, EB24, EB26, EB66, or EBvl3.

In some embodiments, the eukaryotic cells are stem cells. The stem cells can be, for example, pluripotent stem cells, including embryonic stem cells (ESCs), adult stem cells, induced pluripotent stem cells (iPSCs), tissue specific stem cells (e.g., hematopoietic stem cells) and mesenchymal stem cells (MSCs).

In one embodiment, the cell is a differentiated form of any of the cells described herein. In one embodiment, the cell is a cell derived from any primary cell in culture. In some embodiments, the cells are not derived from stem cells. For example, in some embodiments, the cells are used in immunotherapies (e.g., lymphocytes) both extracted and isolated from individual patients or from established cell banks. In some embodiments, the cells can include genetically manipulated cells (i.e. CAR-T, etc.)

In embodiments, the cell is a hepatocyte such as a human hepatocyte, animal hepatocyte, or a non-parenchymal cell. For example, the cell can be a plateable metabolism qualified human hepatocyte, a plateable induction qualified human hepatocyte, plateable QUALYST TRANSPORTER CERTIFIED™ human hepatocyte, suspension qualified human hepatocyte (including 10-donor and 20-donor pooled hepatocytes), human hepatic Kupffer cells, human hepatic stellate cells, dog hepatocytes (including single and pooled Beagle hepatocytes), mouse hepatocytes (including CD-1 and C57Bl/6 hepatocytes), rat hepatocytes (including Sprague-Dawley, Wistar Han, and Wistar hepatocytes), monkey hepatocytes (including Cynomolgus or Rhesus monkey hepatocytes), cat hepatocytes (including Domestic Shorthair hepatocytes), and rabbit hepatocytes (including New Zealand White hepatocytes). Example hepatocytes are commercially available from Triangle Research Labs, LLC, 6 Davis Drive Research Triangle Park, North Carolina, USA 27709.

In one embodiment, the eukaryotic cell is a lower eukaryotic cell such as e.g. a yeast cell (e.g., *Pichia* genus (e.g. *Pichia pastoris, Pichia methanolica, Pichia kluyveri*, and *Pichia angusta*), *Komagataella* genus (e.g. *Komagataella pastoris, Komagataella pseudopastoris* or *Komagataella phaffli*), *Saccharomyces* genus (e.g. *Saccharomyces cerevisiae, Saccharomyces kluyveri, Saccharomyces uvarum*), *Kluyveromyces* genus (e.g. *Kluyveromyces lactis, Kluyveromyces marxianus*), the *Candida* genus (e.g. *Candida utilis, Candida cacaoi, Candida boidinii*), the *Geotrichum* genus (e.g. *Geotrichum fermentans*), *Hansenula polymorpha, Yarrowia lipolytica,* or *Schizosaccharomyces pombe*. Preferred is the species *Pichia pastoris*. Examples for *Pichia pastoris* strains are X33, GS115, KM71, KM71H; and CBS7435.

In one embodiment, the eukaryotic cell is a fungal cell (e.g. *Aspergillus* (such as *A. niger, A. fumigatus, A. orzyae, A. nidula*), *Acremonium* (such as *A. thermophilum*), *Chaetomium* (such as *C. thermophilum*), *Chrysosporium* (such as *C. thermophile*), *Cordyceps* (such as *C. militaris*), *Corynascus, Ctenomyces, Fusarium* (such as *F. oxysporum*), *Glomerella* (such as *G. graminicola*), *Hypocrea* (such as *H. jecorina*), *Magnaporthe* (such as *M. orzyae*), *Myceliophthora* (such as *M. thermophile*), *Nectria* (such as *N. heamatococca*), *Neurospora* (such as *N. crassa*), *Penicillium, Sporotrichum* (such as *S. thermophile*), *Thielavia* (such as *T. terrestris, T. heterothallica*), *Trichoderma* (such as *T. reesei*), or *Verticillium* (such as *V. dahlia*)).

In one embodiment, the eukaryotic cell is an insect cell (e.g., Sf9, MIMIC™ Sf9, Sf21, HIGH FIVE™ (BT1-TN-5B1-4), or BT1-Ea88 cells), an algae cell (e.g., of the genus *Amphora, Bacillariophyceae, Dunaliella, Chlorella, Chlamydomonas, Cyanophyta* (cyanobacteria), *Nannochloropsis, Spirulina*, or *Ochromonas*), or a plant cell (e.g., cells from monocotyledonous plants (e.g., maize, rice, wheat, or *Setaria*), or from a dicotyledonous plants (e.g., cassava, potato, soybean, tomato, tobacco, alfalfa, *Physcomitrella patens* or *Arabidopsis*).

In one embodiment, the cell is a bacterial or prokaryotic cell. In some embodiments, the prokaryotic cell is a Gram-positive cell such as *Bacillus, Streptomyces Streptococcus, Staphylococcus* or *Lactobacillus. Bacillus* that can be used is, e.g. the *B. subtilis, B. amyloliquefaciens, B. licheniformis, B. natto,* or *B. megaterium*. In embodiments, the cell is *B. subtilis*, such as *B. subtilis* 3NA and *B. subtilis* 168. *Bacillus* is obtainable from, e.g., the *Bacillus* Genetic Stock Center, Biological Sciences 556, 484 West 12$^{th}$ Avenue, Columbus Ohio 43210-1214.

In one embodiment, the prokaryotic cell is a Gram-negative cell, such as *Salmonella* spp. or *Escherichia coli*, such as e.g., TG1, TG2, W3110, DH1, DHB4, DH5a, HMS 174, HMS174 (DE3), NM533, C600, HB101, JM109, MC4100, XL1-Blue and Origami, as well as those derived from *E. coli* B-strains, such as for example BL-21 or BL21 (DE3), all of which are commercially available. Suitable host cells are commercially available, for example, from culture collections such as the DSMZ (Deutsche Sammlung von Mikroorganismen and Zellkulturen GmbH, Braunschweig, Germany) or the American Type Culture Collection (ATCC). In some embodiments, the cells include other microbiota utilized as therapeutic agents. These include microbiota present in the human microbiome belonging to the phyla Firmicutes, Bacteroidetes, Proteobacteria, Verrumicrobia, Actinobacteria, Fusobacteria and Cyanobacteria. Microbiota can include both aerobic, strict anaerobic or facultative anaerobic and include cells or spores. Therapeutic Microbiota can also include genetically manipulated organisms and vectors utilized in their modification. Other microbiome-related therapeutic organisms can include: archaea, fungi and virus. See, e.g., The Human Microbiome Project Consortium. *Nature* 486, 207-214 (14 Jun. 2012); Weinstock, *Nature,* 489 (7415): 250-256 (2012); Lloyd-Price, Genome Medicine 8:51 (2016).

In some embodiments, the cultured cells are used to produce proteins e.g., antibodies, e.g., monoclonal antibodies, and/or recombinant proteins, for therapeutic use. In embodiments, the cultured cells produce peptides, amino acids, fatty acids or other useful biochemical intermediates or metabolites. For example, in embodiments, molecules having a molecular weight of about 4000 Daltons to greater than about 140,000 Daltons can be produced. In embodiments, these molecules can have a range of complexity and can include post-translational modifications including glycosylation.

In embodiments, the protein is, e.g., BOTOX, Myobloc, Neurobloc, Dysport (or other serotypes of botulinum neurotoxins), alglucosidase alpha, daptomycin, YH-16, choriogonadotropin alpha, filgrastim, cetrorelix, interleukin-2, aldesleukin, teceleulin, denileukin diftitox, interferon alpha-n3 (injection), interferon alpha-ni, DL-8234, interferon, Suntory (gamma-la), interferon gamma, thymosin alpha 1, tasonermin, DigiFab, ViperaTAb, EchiTAb, CroFab, nesiritide, abatacept, alefacept, Rebif, eptoterminalfa, teriparatide (osteoporosis), calcitonin injectable (bone disease), calcitonin (nasal, osteoporosis), etanercept, hemoglobin glutamer 250 (bovine), drotrecogin alpha, collagenase, carperitide, recombinant human epidermal growth factor (topical gel, wound healing), DWP401, darbepoetin alpha, epoetin omega, epoetin beta, epoetin alpha, desirudin, lepirudin, bivalirudin, nonacog alpha, Mononine, eptacog alpha (activated), recombinant Factor VIII+VWF, Recombinate, recombinant Factor VIII, Factor VIII (recombinant), Alphnmate, octocog alpha, Factor VIII, palifermin, Indikinase, tenecteplase, alteplase, pamiteplase, reteplase, nateplase, monteplase, follitropin alpha, rFSH, hpFSH, micafungin, pegfilgrastim, lenograstim, nartograstim, sermorelin, glucagon, exenatide, pramlintide, iniglucerase, galsulfase, Leucotropin, molgramostim, triptorelin acetate, histrelin (subcutaneous implant, Hydron), deslorelin, histrelin, nafarelin, leuprolide sustained release depot (ATRIGEL), leuprolide implant (DUROS), goserelin, Eutropin, KP-102 program, somatropin, mecasermin (growth failure), enlfavirtide, Org-33408, insulin glargine, insulin glulisine, insulin (inhaled), insulin lispro, insulin deternir, insulin (buccal, RapidMist), mecasermin rinfabate, anakinra, celmoleukin, 99 mTc-apcitide injection, myelopid, Betaseron, glatiramer acetate, Gepon, sargramostim, oprelvekin, human leukocyte-derived alpha interferons, Bilive, insulin (recombinant), recombinant human insulin, insulin aspart, mecasenin, Roferon-A, interferon-alpha 2, Alfaferone, interferon alfacon-1, interferon alpha, Avonex' recombinant human luteinizing hormone, dornase alpha, trafermin, ziconotide, taltirelin, diboterminalfa, atosiban, becaplermin, eptifibatide, Zemaira, CTC-11, Shanvac-B, HPV vaccine (quadrivalent), octreotide, lanreotide, ancestirn, agalsidase beta, agalsidase alpha, laronidase, prezatide copper acetate (topical gel), rasburicase, ranibizumab, Actimmune, PEG-Intron, Tricomin, recombinant house dust mite allergy desensitization injection, recombinant human parathyroid hormone (PTH) 1-84 (sc, osteoporosis), epoetin delta, transgenic antithrombin III, Granditropin, Vitrase, recombinant insulin, interferon-alpha (oral lozenge), GEM-21S, vapreotide, idursulfase, omnapatrilat, recombinant serum albumin, certolizumab pegol, glucarpidase, human recombinant Cl esterase inhibitor (angioedema), lanoteplase, recombinant human growth hormone, enfuvirtide (needle-free injection, Biojector 2000), VGV-1, interferon (alpha), lucinactant, aviptadil (inhaled, pulmonary disease), icatibant, ecallantide, omiganan, Aurograb, pexigananacetate, ADI-PEG-20, LDI-200, degarelix, cintredelinbesudotox, Favld, MDX-1379, ISAtx-247, liraglutide, teriparatide (osteoporosis), tifacogin, AA4500, T4N5 liposome lotion, catumaxomab, DWP413, ART-123, Chrysalin, desmoteplase, amediplase, corifollitropinalpha, TH-9507, teduglutide, Diamyd, DWP-412, growth hormone (sustained release injection), recombinant G-CSF, insulin (inhaled, AIR), insulin (inhaled, Technosphere), insulin (inhaled, AERx), RGN-303, DiaPep277, interferon beta (hepatitis C viral infection (HCV)), interferon alpha-n3 (oral), belatacept, transdermal insulin patches, AMG-531, MBP-8298, Xerecept, opebacan, AID-SVAX, GV-1001, LymphoScan, ranpirnase, Lipoxysan, lusupultide, MP52 (beta-tricalciumphosphate carrier, bone regeneration), melanoma vaccine, sipuleucel-T, CTP-37, Insegia, vitespen, human thrombin (frozen, surgical bleeding), thrombin, TransMID, alfimeprase, Puricase, terlipressin (intravenous, hepatorenal syndrome), EUR-1008M, recombinant FGF-I (injectable, vascular disease), BDM-E, rotigaptide, ETC-216, P-113, MBI-594AN, duramycin (inhaled, cystic fibrosis), SCV-07, OPI-45, Endostatin, Angiostatin, ABT-510, Bowman Birk Inhibitor Concentrate, XMP-629, 99 mTc-Hynic-Annexin V, kahalalide F, CTCE-9908, teverelix (extended release), ozarelix, rornidepsin, BAY-504798, interleukin4, PRX-321, Pepscan, iboctadekin, rhlactoferrin, TRU-015, IL-21, ATN-161, cilengitide, Albuferon, Biphasix, IRX-2, omega interferon, PCK-3145, CAP-232, pasireotide, huN901-DMI, ovarian cancer immunotherapeutic vaccine, SB-249553, Oncovax-CL, OncoVax-P, BLP-25, CerVax-16, multi-epitope peptide melanoma vaccine (MART-1, gp100, tyrosinase), nemifitide, rAAT (inhaled), rAAT (dermatological), CGRP (inhaled, asthma), pegsunercept, thymosinbeta4, plitidepsin, GTP-200, ramoplanin, GRASPA, OBI-1, AC-100, salmon calcitonin (oral, eligen), calcitonin (oral, osteoporosis), examorelin, capromorelin, Cardeva, velafermin, 131I-TM-601, KK-220, T-10, ularitide, depelestat, hematide, Chrysalin (topical), rNAPc2, recombinant Factor V111 (PEGylated liposomal), bFGF, PEGylated recombinant staphylokinase variant, V-10153, SonoLysis Prolyse, NeuroVax, CZEN-002, islet cell neogenesis therapy, rGLP-1, BIM-51077, LY-548806, exenatide (controlled release, Medisorb), AVE-0010, GA-GCB, avorelin, ACM-9604, linaclotid eacetate, CETi-1, Hemospan, VAL (injectable), fast-acting insulin (injectable, Viadel), intranasal insulin, insulin (inhaled), insulin (oral, eligen), recombinant methionyl human leptin, pitrakinra subcutancous injection, eczema), pitrakinra (inhaled dry powder, asthma), Multikine, RG-1068, MM-093, NBI-6024, AT-001, PI-0824, Org-39141, Cpn10 (autoimmune diseases/inflammation), talactoferrin (topical), rEV-131 (ophthalmic), rEV-131 (respiratory disease), oral recombinant human insulin (diabetes), RPI-78M, oprelvekin (oral), CYT-99007 CTLA4-Ig, DTY-001, valategrast, interferon alpha-n3 (topical), IRX-3, RDP-58, Tauferon, bile salt stimulated lipase, Merispase, alaline phosphatase, EP-2104R, Melanotan-II, bremelanotide, ATL-104, recombinant human microplasmin, AX-200, SEMAX, ACV-1, Xen-2174, CJC-1008, dynorphin A, SI-6603, LAB GHRH, AER-002, BGC-728, malaria vaccine (virosomes, PeviPRO), ALTU-135, parvovirus B19 vaccine, influenza vaccine (recombinant neuraminidase), malaria/HBV vaccine, anthrax vaccine, Vacc-5q, Vacc-4x, HIV vaccine (oral), HPV vaccine, Tat Toxoid, YSPSL, CHS-13340, PTH(1-34) liposomal cream (Novasome), Ostabolin-C, PTH analog (topical, psoriasis), MBRI-93.02, MTB72F vaccine (tuberculosis), MVA-Ag85A vaccine (tuberculosis), FARA04, BA-210, recombinant plague FIV vaccine, AG-702, OxSODrol, rBetV1, Der-p1/Der-p2/Der-p7 allergen-targeting vaccine (dust mite allergy), PRI peptide antigen (leukemia), mutant ras vaccine, HPV-16 E7 lipopeptide vaccine, labyrinthin vaccine (adenocarcinoma), CML vaccine, WTI-peptide vaccine (cancer), IDD-5, CDX-110, Pentrys, Norelin, CytoFab, P-9808, VT-111, icrocaptide, telbermin (dermatological, diabetic foot ulcer), rupintrivir, reticulose, rGRF, HA, alpha-galactosidase A, ACE-011, ALTU-140, CGX-1160, angiotensin therapeutic vaccine, D-4F, ETC-642, APP-018, rhMBL, SCV-07 (oral, tuberculosis), DRF-7295, ABT-828, ErbB2-specific immunotoxin (anticancer), DT3SSIL-3, TST-10088, PRO-1762, Combotox, cholecystokinin-B/gastrin-receptor binding peptides, 111In-hEGF, AE-37, trasnizumab-DM1, Antagonist G, IL-12 (recombinant), PM-02734, IMP-321, rhIGF-BP3, BLX-883, CUV-1647 (topical), L-19 based radioimmunotherapeutics (cancer), Re-188-P-2045, AMG-386, DC/1540/KLH vaccine (cancer), VX-001, AVE-9633, AC-9301, NY-ESO-1 vaccine (peptides), NA17.A2 peptides, melanoma vaccine (pulsed antigen therapeutic), prostate cancer vaccine, CBP-501, recombinant human lactoferrin (dry eye), FX-06, AP-214, WAP-8294A (injectable), ACP-HIP, SUN-11031, peptide YY [3-36] (obesity, intranasal), FGLL, atacicept, BR3-Fc, BN-003, BA-058, human parathyroid hormone 1-34 (nasal, osteoporosis), F-18-CCRI, AT-1100 (celiac disease/diabetes), JPD-003, PTH(7-34) liposomal cream (Novasome), duramycin (ophthalmic, dry eye), CAB-2, CTCE-0214, GlycoPEGylated erythropoietin, EPO-Fc, CNTO-528, AMG-114, JR-013, Factor XIII, aminocandin, PN-951, 716155, SUN-E7001, TH-0318, BAY-73-7977, teverelix (immediate release), EP-51216, hGH (controlled release, Biosphere), OGP-I, sifuvirtide, TV4710, ALG-889, Org-41259, rhCC10, F-991, thymopentin (pulmonary diseases), r(m)CRP, hepatoselective insulin, subalin, L19-IL-2 fusion protein, elafin, NMK-150, ALTU-139, EN-122004, rhTPO, thrombopoietin receptor agonist (thrombocytopenic disorders), AL-108, AL-208, nerve growth factor antagonists (pain), SLV-317, CGX-1007, INNO-105, oral teriparatide (eligen), GEM-OS1, AC-162352, PRX-302, LFn-p24 fusion vaccine (Therapore), EP-1043, *S. pneumoniae* pediatric vaccine, malaria vaccine, *Neisseria meningitidis* Group B vaccine, neonatal group B streptococcal vaccine, anthrax vaccine, HCV vaccine (gpE1+gpE2+MF-59), otitis media therapy, HCV vaccine (core antigen+ISCOMATRIX), hPTH(1-34) (transdermal, ViaDerm), 768974, SYN-101, PGN-0052, aviscumnine, BIM-23190, tuberculosis vaccine, multi-epitope tyrosinase peptide, cancer vaccine, enkastim, APC-8024, GI-5005, ACC-001, TTS-CD3, vascular-targeted TNF (solid tumors), desmopressin (buccal controlled-release), onercept, and TP-9201.

In some embodiments, the polypeptide is adalimumab (HUMIRA), infliximab (REMICADE™), rituximab (RITUXAN™/MABTHERA™) etanercept (ENBREL™), bevacizumab (AVASTIN™), trastuzumab (HERCEPTIN™), pegrilgrastim (NEULASTA™), or any other suitable polypeptide including biosimilars and biobetters.

Other suitable polypeptides are those listed below in Table 6 and in Table 1 of US2016/0097074. One of skill in the art can appreciate that the disclosure of the present invention additional would encompass combinations of products and/or conjugates as described herein [(i.e. multi-proteins, modified proteins (conjugated to PEG, toxins, other active ingredients)].

TABLE 6

| Protein Product | Reference Listed Drug |
|---|---|
| interferon gamma-1b | ACTIMMUNE ® |
| alteplase; tissue plasminogen activator | ACTIVASE ®/CATHFLO ® |
| recombinant antihemophilic factor | ADVATE |
| human albumin | ALBUTEIN ® |
| Laronidase | ALDURAZYME ® |
| interferon alfa-N3, human leukocyte derived | ALFERON N ® |
| human antihemophilic factor | ALPHANATE ® |
| virus-filtered human coagulation factor IX | ALPHANINE ® SD |
| Alefacept; recombinant, dimeric fusion protein LFA3-Ig | AMEVIVE ® |
| Bivalirudin | ANGIOMAX ® |
| darbepoetin alfa | ARANESP ™ |
| Bevacizumab | AVASTIN ™ |
| interferon beta-1a; recombinant | AVONEX ® |
| coagulation factor IX | BENEFIX ™ |
| interferon beta-1b | BETASERON ® |
| Tositumomab | BEXXAR ® |
| antihemophilic factor | BIOCLATE ™ |
| human growth hormone | BIOTROPIN ™ |
| botulinum toxin type A | BOTOX ® |
| Alemtuzumab | CAMPATH ® |
| acritumomab; technetium-99 labeled | CEA-SCAN ® |
| alglucerase; modified form of beta-glucocerebrosidase | CEREDASE ® |
| imiglucerase; recombinant form of beta-glucocerebrosidase | CEREZYME ® |
| crotalidae polyvalent immune Fab, ovine | CROFAB ™ |
| Digoxin immune fab [ovine] | DIGIFAB ™ |
| Rasburicase | ELITEK ® |
| Etanercept | ENBREL ® |
| Epoietin alfa | EPOGEN ® |

TABLE 6-continued

| Protein Product | Reference Listed Drug |
|---|---|
| Cetuximab | ERBITUX ™ |
| Algasidase beta | FABRAZYME ® |
| Urofollitropin | FERINEX ™ |
| Follitropin beta | FOLLISTIM ™ |
| Teriparatide | FORTEO ® |
| Human somatropin | GENOTROPIN ® |
| Glucagon | GLUCAGEN ® |
| Follitropin alfa | GONAL-F ® |
| Antihemophillic factor | HELIXATE ® |
| Antihemophilic factor; Factor XIII | HEMOFIL |
| Adefovir dipivoxil | HEPSERA ™ |
| trastuzumab | HERCEPTIN ® |
| Insulin | HUMALOG ® |
| Antihemophilic factor/von Willebrand factor complex-human | HUMATE-P ® |
| Somatotropin | HUMATROPE ® |
| Adalimumab | HUMIRA ™ |
| Human insulin | HUMULIN ® |
| Recombinant human hyaluronidase | HYLENEX ™ |
| Interferon alfacon-1 | INFERGEN ® |
| Eptifibatide | INTEGRILLIN ™ |
| Alpha-interferon | INTRON A ® |
| Palifermin | KEPIVANCE |
| Anakinra | KINERET ™ |
| Antihemophilic factor | KOGENATE ®FS |
| Insulin glargine | LANTUS ® |
| Granulocyte macrophage colony-simulating factor | LEUKINE ®/LEUKINE ®LIQUID |
| Lutropin alfa for injection | LUVERIS |
| OspA lipoprotein | LYMERIX ™ |
| Ranibizumab | LUCENTIS ® |
| Gemtuzumab ozogamicin | MYLOTARG ™ |
| Galsulfase | NAGLAZYME ™ |
| Nesiritide | NATRECOR ® |
| Pegfilgrastim | NEULASTA ™ |
| Oprelvekin | NEUMEGA ® |
| Filgrastim | NEUPOGEN ® |
| Fanolesomab | NEUTROSPEC ™ (FORMERLY LEUTECH ®) |
| Somatropin [rDNA] | NORDITROPIN ®/NORDITROPIN NORDIFLEX ® |
| Mitoxantrone | NOVANTRONE ® |
| Insulin; zinc suspension | NOVOLIN L ® |
| Insulin; isophane suspension | NO VOLIN N ® |
| Insulin, regular | NOVOLIN R ® |
| Insulin | NOVOLIN ® |
| Coagulation factor VIIa | NOVOSEVEN ® |
| Somatropin | NUTROPIN ® |
| Immunoglobulin intravenous | OCTAGAM ® |
| PEG-L-asparaginase | ONCASPAR ® |
| Abatacept, fully human soluable fusion protein | ORENCIA ™ |
| Muromomab-CD3 | ORTHOCLONE OKT3 ® |
| High-molecular weight hyaluronan | ORTHOVISC ® |
| Human chorionic gonadotropin | OVIDREL ® |
| Live attenuated *Bacillus* Calmette-Guerin | PACIS ® |
| Peginterferon alfa-2a | PEGASYS ® |
| Pegylated version of interferon alfa-2b | PEG-INTRON ™ |
| Abarelix (Injection suspension); gonadotropin-releasing hormone antagonist | PLENAXIS ™ |
| Epoietin alfa | PROCRIT ® |
| Aldesleukin | PROLEUKIN, IL-2 ® |
| Somatrem | PROTROPIN ® |
| Dornase alfa | PULMOZYME ® |
| Efalizumab; selective, reversible T-cell blocker | RAPTIVA ™ |
| Combination of ribavirin and alpha interferon | REBETRON ™ |
| Interferon beta 1a | REBIF ® |
| Antihemophilic factor | RECOMBINATE ® RAHF |
| Antihemophilic factor | REFACTO ® |
| Lepirudin | REFLUDAN ® |
| Infliximab | REMICADE ® |
| Abciximab | REOPRO ™ |
| Reteplase | RETAVASE ™ |
| Rituxima | RITUXAN ™ |
| Interferon alfa-2[a] | ROFERON-A ® |
| Somatropin | SAIZEN ® |
| Synthetic porcine secretin | SECREFLO ™ |
| Basiliximab | SIMULECT ® |
| Eculizumab | SOLIRIS ® |
| Pegvisomant | SOMAVERT ® |

TABLE 6-continued

| Protein Product | Reference Listed Drug |
|---|---|
| Palivizumab; recombinantly produced, humanized mAb | SYNAGIS ™ |
| Thyrotropin alfa | THYROGEN ® |
| Tenecteplase | TNKASE ™ |
| Natalizumab | TYSABRI ® |
| Human immune globulin intravenous 5% and 10% solutions | VENOGLOBULIN-S ® |
| Interferon alfa-n1, lymphoblastoid | WELLFERON ® |
| Drotrecogin alfa | XIGRIS ™ |
| Omaluzumab; recombinant DNA-derived humanized monoclonal antibody targeting immunoglobulin-E | XOLAIR ® |
| Daclizumab | ZENAPAX ® |
| Ibritumomab tiuxetan | ZEVALIN ™ |
| Somatotropin | ZORBTIVE ™ (SEROSTIM ®) |

In embodiments, the polypeptide is a hormone, blood clotting/coagulation factor, cytokine/growth factor, antibody molecule, fusion protein, protein vaccine, or peptide as shown in Table 7.

TABLE 7

Exemplary Products

| Therapeutic Product type | Product | Trade Name |
|---|---|---|
| Hormone | Erythropoietin, Epoein-α | Epogen, Procrit |
| | Darbepoetin-α | Aranesp |
| | Growth hormone (GH), somatotropin | Genotropin, Humatrope, Norditropin, NovIVitropin, Nutropin, Omnitrope, Protropin, Siazen, Serostim, Valtropin |
| | Human follicle-stimulating hormone (FSH) | Gonal-F, Follistim |
| | Human chorionic gonadotropin | Ovidrel, Luveris |
| | Lutropin-α | GlcaGen |
| | Glucagon | Geref |
| | Growth hormone releasing hormone (GHRH) | ChiRhoStim (human peptide), SecreFlo (porcine peptide) |
| | Secretin | |
| | Thyroid stimulating hormone (TSH), thyrotropin | Thyrogen |
| Blood Clotting/ Coagulation Factors | Factor VIIa | Novo Seven |
| | Factor VIII | Bioclate, Helixate, Kogenate, Recombinate, ReFacto |
| | Factor IX | Benefix |
| | Antithrombin III (AT-III) | Thrombate III |
| | Protein C concentrate | Ceprotin |
| Cytokine/Growth factor | Type I alpha-interferon | Infergen |
| | Interferon-αn3 (IFNαn3) | Alferon N |
| | Interferon-β1a (rIFN-β) | Avonex, Rebif |
| | Interferon-β1b (rIFN-β) | Betaseron |
| | Interferon-γ1b (IFN γ) | Actimmune |
| | Aldesleukin (interleukin 2(IL2), epidermal theymocyte activating factor; ETAF | Proleukin |
| | Palifermin (keratinocyte growth factor; KGF) | Kepivance |
| | Becaplemin (platelet-derived growth factor; PDGF) | Regranex |
| | Anakinra (recombinant IL1 antagonist) | Anril, Kineret |
| Antibody molecules | Bevacizumab (VEGFA mAb) | Avastin, Erbitux |
| | Cetuximab (EGFR mAb) | Vectibix |
| | Panitumumab (EGFR mAb) | Campath |
| | Alemtuzumab (CD52 mAb) | Rituxan |
| | rituximab (CD20 chimeric Ab) | Herceptin, Orencia |
| | Trastuzumab (HER2/Neu mAb) | Humira, Enbrel |
| | Abatacept (CTLA Ab/Fc fusion) | Remicade |
| | Adalimumab (TNFα mAb) | Amevive |
| | Etanercept (TNF receptor/Fc fusion) | Raptiva, Tysabri |
| | Infliximab (TNFα chimeric mAb) | Soliris, Orthoclone, OKT3 |
| | Alefacept (CD2 fusion protein) | |
| | Efalizumab (CD11a mAb) | |

TABLE 7-continued

Exemplary Products

| Therapeutic Product type | Product | Trade Name |
|---|---|---|
| | Natalizumab (integrin α4 subunit mAb) | |
| | Eculizumab (C5mAb) | |
| | Muromonab-CD3 | |
| Other: | Insulin | Humulin, Novolin |
| | Hepatitis B surface antigen (HBsAg) | Engerix, Recombivax HB |
| | HPV vaccine | Gardasil |
| Fusion proteins/Protein vaccines/Peptides | OspA | LYMErix |
| | Anti-Rhesus(Rh) immunoglobulin G | Rhophylac |
| | Enfuvirtide | Fuzeon |
| | Spider silk, e.g., fibrion | QMONOS |

In embodiments, the protein is multispecific protein, e.g., a bispecific antibody as shown in Table 8.

TABLE 8

Bispecific Formats

| Name (other names, sponsoring organizations) | BsAb format | Targets | Proposed mechanisms of action | Development stages | Diseases (or healthy volunteers) |
|---|---|---|---|---|---|
| Catumaxomab (REMOVAB ®, Fresenius Biotech, Trion Pharma, Neopharm) | BsIgG: Triomab | CD3, EpCAM | Retargeting of T cells to tumor, Fc mediated effector functions | Approved in EU | Malignant ascites in EpCAM positive tumors |
| Ertumaxomab (Neovii Biotech, Fresenius Biotech) | BsIgG: Triomab | CD3, HER2 | Retargeting of T cells to tumor | Phase I/II | Advanced solid tumors |
| Blinatumomab (BLINCYTO ®, AMG 103, MT 103, MEDI 538, Amgen) | BiTE | CD3, CD19 | Retargeting of T cells to tumor | Approved in USA Phase II and III Phase II Phase I | Precursor B-cell ALL ALL DLBCL NHL |
| REGN1979 (Regeneron) | BsAb | CD3, CD20 | | | |
| Solitomab (AMG 110, MT110, Amgen) | BiTE | CD3, EpCAM | Retargeting of T cells to tumor | Phase I | Solid tumors |
| MEDI 565 (AMG 211, MedImmune, Amgen) | BiTE | CD3, CEA | Retargeting of T cells to tumor | Phase I | Gastrointestinal adenocancinoma |
| RO6958688 (Roche) | BsAb | CD3, CEA | | | |
| BAY2010112 (AMG 212, Bayer; Amgen) | BiTE | CD3, PSMA | Retargeting of T cells to tumor | Phase I | Prostate cancer |
| MGD006 (Macrogenics) | DART | CD3, CD123 | Retargeting of T cells to tumor | Phase I | AML |
| MGD007 (Macrogenics) | DART | CD3, gpA33 | Retargeting of T cells to tumor | Phase I | Colorectal cancer |
| MGD011 (Macrogenics) | DART | CD19, CD3 | | | |
| SCORPION (Emergent Biosolutions, Trubion) | BsAb | CD3, CD19 | Retargeting of T cells to tumor | | |
| AFM11 (Affimed Therapeutics) | TandAb | CD3, CD19 | Retargeting of T cells to tumor | Phase I | NHL and ALL |
| AFM12 (Affimed Therapeutics) | TandAb | CD19, CD16 | Retargeting of NK cells to tumor cells | | |
| AFM13 (Affimed Therapeutics) | TandAb | CD30, CD16A | Retargeting of NK cells to tumor cells | Phase II | Hodgkin's Lymphoma |

TABLE 8-continued

Bispecific Formats

| Name (other names, sponsoring organizations) | BsAb format | Targets | Proposed mechanisms of action | Development stages | Diseases (or healthy volunteers) |
|---|---|---|---|---|---|
| GD2 (Barbara Ann Karmanos Cancer Institute) | T cells preloaded with BsAb | CD3, GD2 | Retargeting of T cells to tumor | Phase I/II | Neuroblastoma and osteosarcoma |
| pGD2 (Barbara Ann Karmanos Cancer Institute) | T cells preloaded with BsAb | CD3, Her2 | Retargeting of T cells to tumor | Phase II | Metastatic breast cancer |
| EGFRBi-armed autologous activated T cells (Roger Williams Medical Center) | T cells preloaded with BsAb | CD3, EGFR | Autologous activated T cells to EGFR-positive tumor | Phase I | Lung and other solid tumors |
| Anti-EGFR-armed activated T-cells (Barbara Ann Karmanos Cancer Institute) | T cells preloaded with BsAb | CD3, EGFR | Autologous activated T cells to EGFR-positive tumor | Phase I | Colon and pancreatic cancers |
| rM28 (University Hospital Tübingen) | Tandem scFv | CD28, MAPG | Retargeting of T cells to tumor | Phase II | Metastatic melanoma |
| IMCgp100 (Immunocore) | ImmTAC | CD3, peptide MHC | Retargeting of T cells to tumor | Phase I/II | Metastatic melanoma |
| DT2219ARL (NCI, University of Minnesota) | 2 scFv linked to diphtheria toxin | CD19, CD22 | Targeting of protein toxin to tumor | Phase I | B cell leukemia or lymphoma |
| XmAb5871 (Xencor) | BsAb | CD19, CD32b | | | |
| NI-1701 (NovImmune) | BsAb | CD47, CD19 | | | |
| MM-111 (Merrimack) | BsAb | ErbB2, ErbB3 | | | |
| MM-141 (Merrimack) | BsAb | IGF-1R, ErbB3 | | | |
| NA (Merus) | BsAb | HER2, HER3 | | | |
| NA (Merus) | BsAb | CD3, CLEC12A | | | |
| NA (Merus) | BsAb | EGFR, HER3 | | | |
| NA (Merus) | BsAb | PD1, undisclosed | | | |
| NA (Merus) | BsAb | CD3, undisclosed | | | |
| Duligotuzumab (MEHD7945A, Genentech, Roche) | DAF | EGFR, HER3 | Blockade of 2 receptors, ADCC | Phase I and II Phase II | Head and neck cancer Colorectal cancer |
| LY3164530 (Eli Lily) | Not disclosed | EGFR, MET | Blockade of 2 receptors | Phase I | Advanced or metastatic cancer |
| MM-111 (Merrimack Pharmaceuticals) | HSA body | HER2, HER3 | Blockade of 2 receptors | Phase II Phase I | Gastric and esophageal cancers Breast cancer |
| MM-141, (Merrimack Pharmaceuticals) | IgG-scFv | IGF-1R, HER3 | Blockade of 2 receptors | Phase I | Advanced solid tumors |
| RG7221 (RO5520985, Roche) | CrossMab | Ang2, VEGFA | Blockade of 2 proangiogenics | Phase I | Solid tumors |
| RG7716 (Roche) | CrossMab | Ang2, VEGFA | Blockade of 2 proangiogenics | Phase I | Wet AMD |
| OMP-305B83 (OncoMed) | BsAb | DLL4/VEGF | | | |
| TF2 (Immunomedics) | Dock and lock | CEA, HSG | Pretargeting tumor for PET or radioimaging | Phase II | Colorectal, breast and lung cancers |
| ABT-981 (AbbVie) | DVD-Ig | IL-1α, IL-1β | Blockade of 2 proinflammatory cytokines | Phase II | Osteoarthritis |
| ABT-122 (AbbVie) | DVD-Ig | TNF, IL-17A | Blockade of 2 proinflammatory cytokines | Phase II | Rheumatoid arthritis |
| COVA322 | IgG-fynomer | TNF, IL17A | Blockade of 2 proinflammatory cytokines | Phase I/II | Plaque psoriasis |
| SAR156597 (Sanofi) | Tetravalent bispecific tandem IgG | IL-13, IL-4 | Blockade of 2 proinflammatory cytokines | Phase I | Idiopathic pulmonary fibrosis |

TABLE 8-continued

Bispecific Formats

| Name (other names, sponsoring organizations) | BsAb format | Targets | Proposed mechanisms of action | Development stages | Diseases (or healthy volunteers) |
|---|---|---|---|---|---|
| GSK2434735 (GSK) | Dual-targeting domain | IL-13, IL-4 | Blockade of 2 proinflammatory cytokines | Phase I | (Healthy volunteers) |
| Ozoralizumab (ATN103, Ablynx) | Nanobody | TNF, HSA | Blockade of proinflammatory cytokine, binds to HSA to increase half-life | Phase II | Rheumatoid arthritis |
| ALX-0761 (Merck Serono, Ablynx) | Nanobody | IL-17A/F, HSA | Blockade of 2 proinflammatory cytokines, binds to HSA to increase half-life | Phase I | (Healthy volunteers) |
| ALX-0061 (AbbVie, Ablynx; | Nanobody | IL-6R, HSA | Blockade of proinflammatory cytokine, binds to HSA to increase half-life | Phase I/II | Rheumatoid arthritis |
| ALX-0141 (Ablynx, Eddingpharm) | Nanobody | RANKL, HSA | Blockade of bone resorption, binds to HSA to increase half-life | Phase I | Postmenopausal bone loss |
| RG6013/ACE910 (Chugai, Roche) | ART-Ig | Factor IXa, factor X | Plasma coagulation | Phase II | Hemophilia |

To realize the benefit of the system for therapeutic proteins, the CHOK1SV SSI comprising multiple RTS sites can be tested for the expression of therapeutic proteins as outlined in Table 10. Experiments can be separated into three phases; Phase 1: Tests the application of multisite SSI to increase qP; Phase 2: Tests the capability of multisite SSI to express a three-gene bispecific mAb across the two SSIS; Phase 3: To express ancillary genes in one site in order to aid the expression of a DtE protein encoded in the other site.

Phase 1:

The limitation of some cell lines comprising a single RTS site is that a single copy of the necessary transcription units is not sufficient to generate suitable titers for clinical manufacturing. Therefor we can evaluate the option to use multiple RTS to increase the integrated copy number of mAb genes. In such an approach mAb genes can be targeted to both landing pads A and B. The homogeneity of the pool can be determined by FACS sorting and analysis of supernatants by Protein A HPLC.

Phase 2:

For the majority of next generation antibodies (e.g. tetravalent bispecific antibodies) the assembly of multiple heavy or light chains is a recurrent problem. In order to obtain optimal product quality with very few unwanted side products, the selection of an appropriate CHO clone expressing as many as four antibody chains in a stable and reproducible is beneficial. As a result, a large amount of product analytics utilizing ELISAs, RP-HPLC or CD-SDS during clone selection is often required. However, in a cell line comprising multiple RTS, the genes encoding a multi chain protein are separated across two sites spatially with individual promoters. This ensure that copy number and relative expression of individual chains are consistent as early as transfectant pools and enabling empirical fine-tuning of the availability of individual polypeptide chains through promoter strength or copy number manipulation of the encoding transcription units. The advantage of this are that product quality is more consistent, reducing the proportion of misfolded multichain recombinant protein produced from SSI-generated pools and cell lines, dramatically recuing the need for early stage assessments. Test molecule: cergutumab amunaleukin.

Phase 3:

Expression of endogenous proteins which results in the expansion of the secretion capacity of the CHOK1SV GS-KO™ cell line is a proven approach to increase product titers. Candidates can be identified from PCT application WO2015018703 A1 and those in Tables 9 and 10 can be evaluated on a cell line comprising multiple distinct recombination target sites (RTS). Product titers can be measured by Protein A HPLC and antibody assembly can be assessed by SDS-PAGE and IEF. Tets molecule: Rituximab, cB72.3, infliximab and Etanercept.

TABLE 9

| Phase | Rational | Therapeutic protein | Ancillary Gene |
|---|---|---|---|
| 1 | mAb genes in multiple SSIS to increase qP | Rituximab, cB72.3 and H31K5 etc. | N/A |
| 2 | Bispecific mAb and >2 chain DtE genes expressed from SSIS | Cergutuzumab amunaleukin etc. | N/A |
| 3 | Ancillary gene expression to increase product quality of DtE | Infliximab etc. | Lipid genes from Candidates identified in U.S. application No. 62/322,621, incorporated herein by reference, the miRNA sponge vectors as found in FIG. 20, and any blood factor proteases. |

TABLE 10

| miR | Target Gene (miR binding site in 3'UTR) | Sponge Sequence (miR Target Sequence in Gene 3'UTR) | Copies of 3'UTR target site |
|---|---|---|---|
| miR-15b and miR-16-1 | CPEB2A | 5'-aggggcaacaca gtctgctgcta-3' (SEQ ID NO: 38) | 1, 3, 6, 9 and 12 |
| miR-15b and miR-16-1 | CPEB2B | 5'-aagctgtattag ctttgctgcta-3' (SEQ ID NO: 39) | |
| miR-34c | SRPRα | 5'-taatcatgttac aatcactgcc-3' (SEQ ID NO: 40) | |
| miR-708 | CNTFR | 5'-caccatcagatt ataagctcctg-3' (SEQ ID NO: 41) | |
| miR-186 | EIF3A | 5'-cagtctaaattg aattcttta-3' (SEQ ID NO: 42) | |

EXAMPLES

Figure 6:
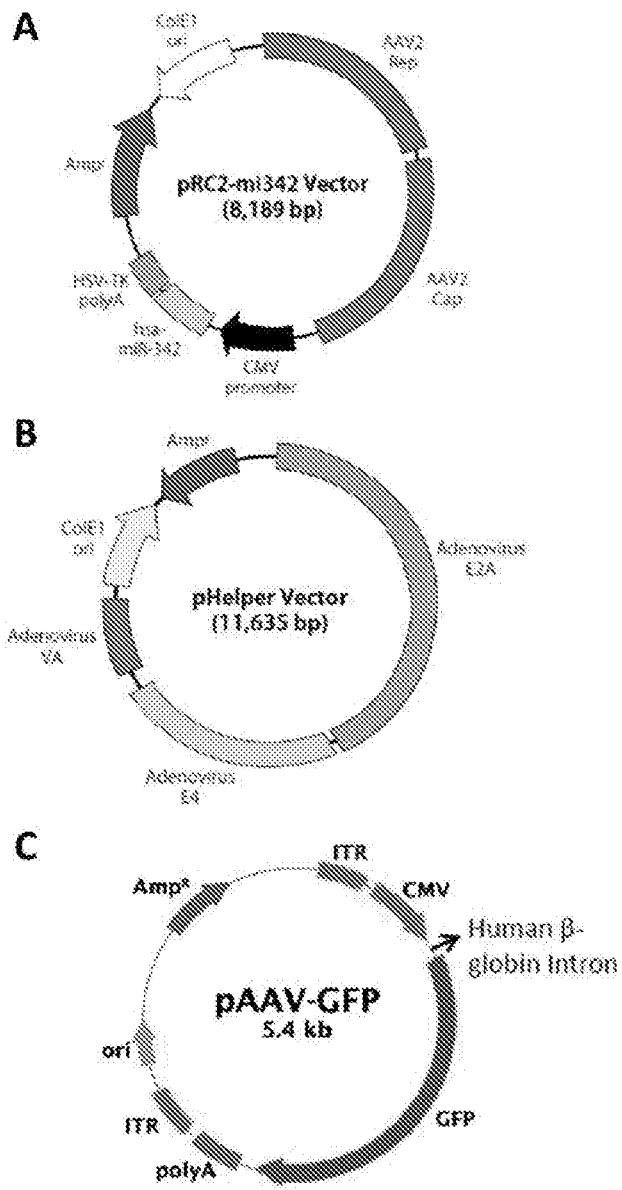
FIG. 6 shows a vector diagram of pRC2-miRNA342 (6234, Clontech) (FIG. 6A), pHelper (6234, Clontech) (FIG. 6B) and pAAV-GFP (AAV-400, Cell Biolabs) (FIG. 6C).

Example 1: Transient AAV Production in CHOK1SV GS-KO™ with Adenovirus 5 Virus Co-Infection To determine whether CHOK1SV GS-KO™ (Lonza, Slough, UK) cells are biologically capable of producing and assembling rAAV vector proteins, CHOK1SV GS-KO™ cells were transfected with two plasmids—pRC2-mi342 (6234, Clontech) and pAAV-GFP (AAV-400, Cell Biolabs) Control Vector (Catalogue number: AAV-400 Cell Biolabs, San Diego, USA) (FIG. 6), in presence of wt Ad5 virus (Catalogue Number: ATCC® VR-1516™, American Type Culture Collection, Manassas, USA). Under natural conditions, CHOK1SV GS-KO™ cells are not receptive to adenovirus since they lack the viral receptor, however, in presence of cationic transfection reagents (lipofectamine or PEI); the negatively charged adenovirus 5 is able to enter the CHOK1SV GS-KO™ cells, thus providing all the helper elements. This concept was used in designing this evaluation experiment where the CHOK1SV GS-KO™ cells were provided all the elements (Rep-Cap and GOI by transfection and Ad5 elements by infection). Cells were harvested 72 hours post-transfection/infection and lysed by going through 4 freeze/thaw cycles, followed by a benzonase treatment to digest any plasmid DNA. The lysate was tested by qPCR for AAV titer, as well as tested for transduction efficiency of HEK293 for transgene (green fluorescent protein—GFP) expression. As a control for this experiment, adherent HEK293 cells were used and cell lysates from a HEK293 triple transfection (pHelper (6234, Clontech), pRC2-mi342 (6234, Clontech), pAAV-GFP (AAV-400, Cell Biolabs) (FIG. 6)) was analyzed the same as for CHOK1SV GS-KO™ cells transfected with pRC2-mi342 (6234, Clontech), pAAV-GFP and infected with wt Ad5. The experimental outline and results from this experiment are presented in FIG. 1. Green fluorescence was detected in CHOK1SV GS-KO™ cells following transfection, indicating successful transfection (FIG. 1B, left panel). The lysate from in CHOK1SV GS-KO™ cells following transfection was used to transduce HEK293 cells, and green fluorescence was detected in HEK293 cells, albeit low (FIG. 1B, right panel), suggesting low level production of AAV. The qPCR data shows an AAV titer of 6.8E+09 vg/mL (FIG. 1C). The positive control, HEK293 with triple transfection produced a higher AAV titer of 1.8e+12 as expected and no AAV was produced in the negative control, HEK293 GFP transfection. To summarize, this is first known experiment, showing that CHOK1SV GS-KO™ cells are capable of producing AAV when provided with all known genomic elements required for AAV packaging.

Figure 2:
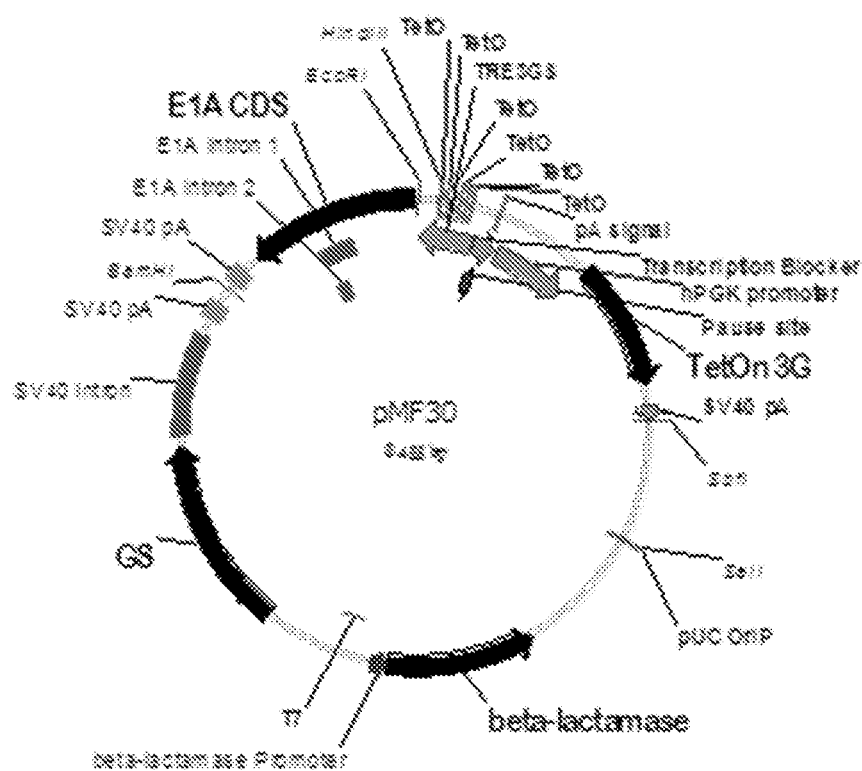
FIG. 2 shows a pMF30 vector diagram. E1A in a TET inducible vector bearing a GS selection marker.
Figure 3:
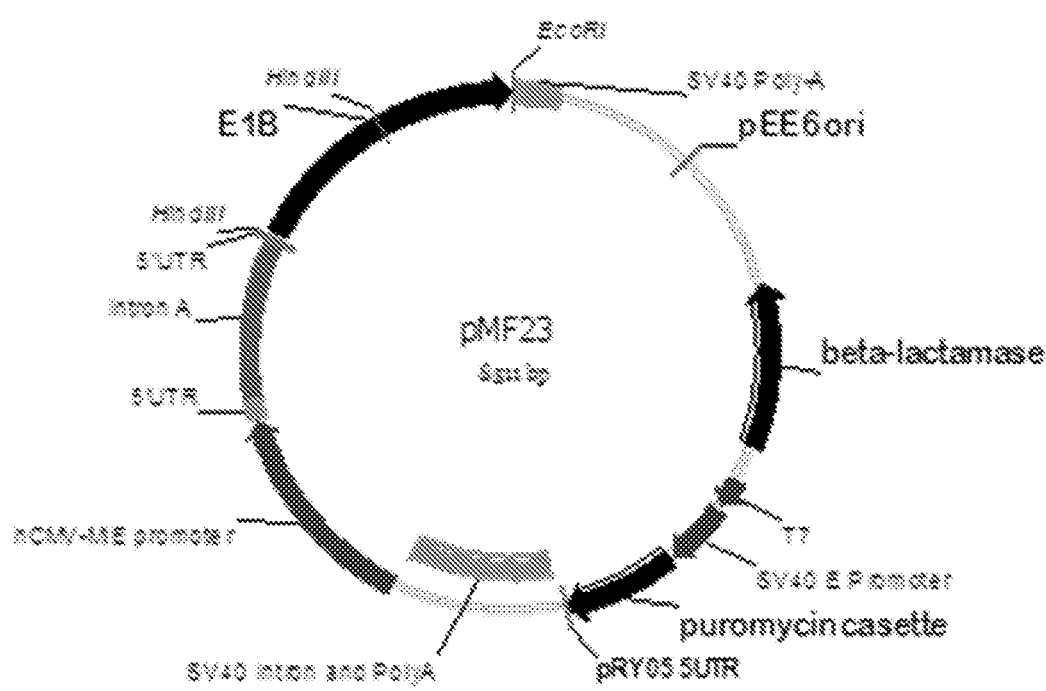
FIG. 3 shows a pMF23 vector diagram. E1B in a constitutive vector bearing a PAC selection marker.
Figure 4:
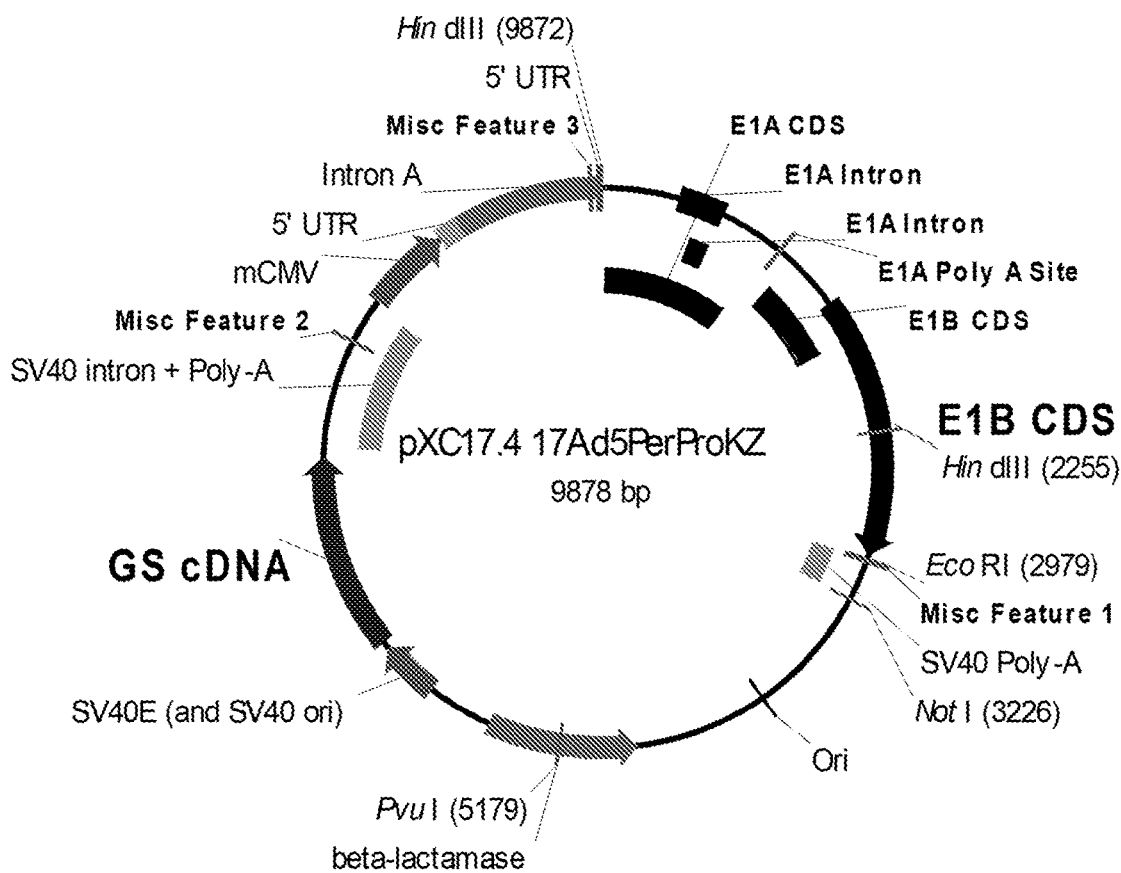
FIG. 4 shows a pXC17.4_17Ad5PerProKZ vector diagram. E1A and E1B was expressed from a single promoter (viral regulatory regions between the two gene and the viral promoter region (nucleotides 498-3635) located between E1A and E1B coding sequence were retained) as described by Qiao et al., *J. Virol.* 76:1904-13 (2002). Annotation matches co-ordinates described in Qiao et al., *J. Virol.* 76:1904-13 (2002).
Figure 5:
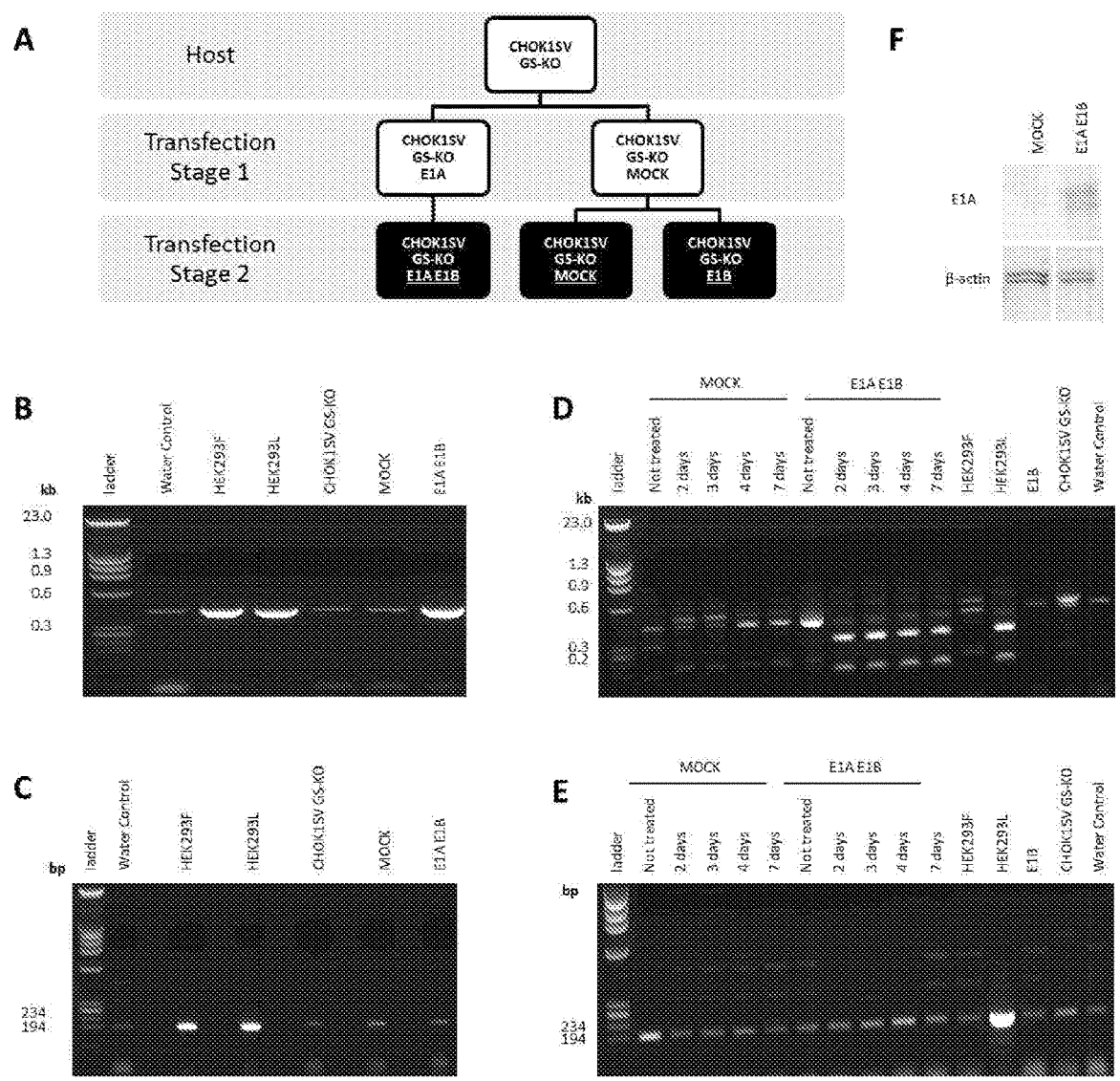
FIG. 5 shows construction of CHOK1SV GS-KO™ pools expressing wt Ad5 E1A and E1B to enable rAAV production in these cells the absence of helper virus.

Example 2: Transient rAAV Production in CHOK1SV GS-KO™ without Virus Co-Infection To determine whether CHOK1SV GS-KO™ cells are capable of producing rAAV in the absence of wt Ad5 virus, cells were engineered to express Ad5 E1A and E1B in a similar approach to Howe et al., 2005. Plasmid constructs were created which express E1A under the control of a TET-on promoter (pMF30, FIG. 2), E1B under the control of a constitutive human CMV promoter (pMF23, FIG. 3) and the Ad5 E1A-E1B open reading frame (pXC17.4_17AV5PerProKZ, FIG. 4). CHOK1SV GS-KO™ derived pools were created by transfecting with pMF30 and selecting for those cells which are able to survive in glutamine-free media supplemented with 50 μM L-MSX (FIG. 5A). This CHOK1SV GS-KO™ E1A was then transfected with pMF23 and selecting for those cells which are able to survive in glutamine-free media supplemented with 50 μM L-MSX and 10 μg/mL Puromycin (FIG. 5A). The water control was contaminated in all of the genomic DNA PCRs, but it is clear that E1A PCR products were amplified in HEK293F and HEK293L cells and pXC17.4_17AV5PerProKZ (FIG. 1B). CHOK1SV GS-KO™ MOCK (MOCK) and CHOK1SV GS-KO™ E1A E1B (E1A E1B) pools were treated with doxycycline (2 μg/ml) to activate the TET promoter and E1A transcription for 0 (not treated), 2, 3, 4 and 7 days, and then the mRNA was isolated for reverse-transcription PCR using primers for E1A (FIG. 1D) and E1B (FIG. 1E). Results show a higher level of E1A 243R and E1A 171R in CHOK1SV GS-KO™ E1A E1B pools treated with doxycycline and in HEK293L cells. The amount of E1B mRNA product did not change following doxycycline treatment, but was noticeably higher in HEK293L cells. E1A protein was detected in CHOK1SV GS-KO™ E1A E1B pool treated with doxycycline for 7 days (E1A E1B), and was not detectable in CHOK1SV GS-KO™ MOCK (MOCK) protein lysates (FIG. 5F). This pool CHOK1SV GS-KO™ E1A_E1B was then tested for the ability to produce rAAV with and without Doxycycline (2 μg/ml). To ensure a high expression of E1A and E1B protein, transient transfection of E1A-E1B plasmid (pXC17.4_17AV5PerProKZ, FIG. 4) in CHOK1SV GS-KO™ cells was also performed. These data show that E1A protein expression can be achieved in CHO without the requirement for wt Ad infection. Confirmation of E1B integration and expression was more challenging.

Figure 7:
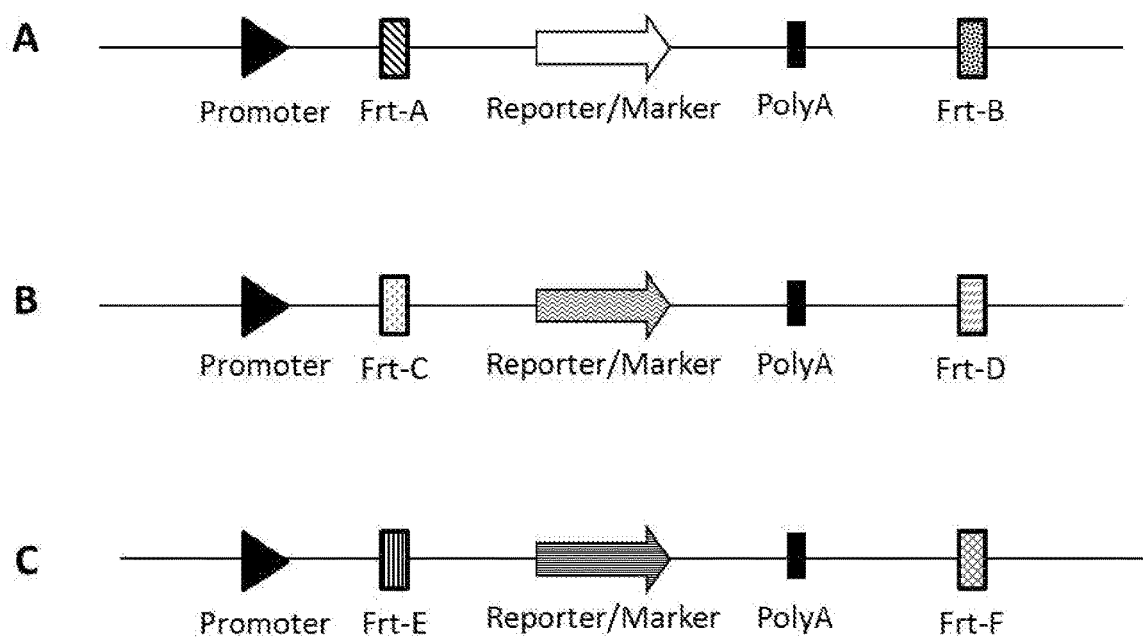
FIG. 7 shows a schematic for three independently addressable site-specific integration sites (SSIS) in CHOK1SV GS-KO™ and HEK293 site-specific integration cell line.
Figure 8:
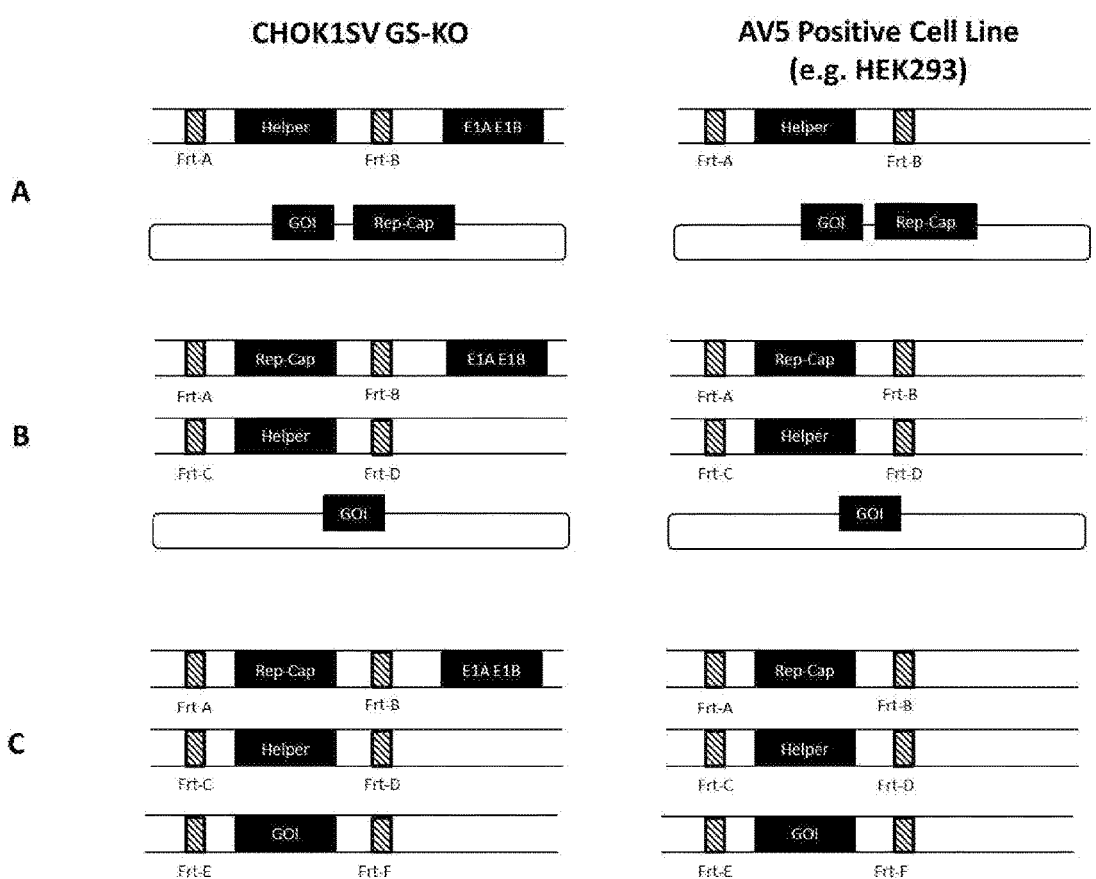
FIG. 8 shows a system schematic for a method of preparing CHOK1SV GS-KO™-AAV producer cells. The SSISs are used for introducing adenovirus (Ad) genes (helper genes), the AAV genes (Rep/Cap) and the AAV vector cassette (e.g. ITR-GOI-ITR), and in CHOK1SV GS-KO™ additional Ad genes (E1A/E1B) are introduced elsewhere with an inducible promoter. In this instance Frt sites A-F could be any of those described in Table 2.

Example 3: Permanent rAAV Production in CHOK1SV GS-KO™ and HEK293 without Virus Co-Infection Landing pads suitable for subsequent RMCE were integrated into the CHOK1SV GS-KO™ and HEK293 genome as loci identified from recombinant CHOK1SV™ cell lines (Fer1L4, NL1, 2, 3, 4, 5 and 6 (see, e.g., WO2013190032A1 and EP2711428A1)). A schematic of the arrangement of elements within these landing pads is presented in FIGS. 7A, B and C). The positioning of the Frt sites between the SV40E promoter and selection marker enables it be used in subsequent rounds of RMCE. The use of incompatible Frt sites (A, B, C, D, E, and F) and a different report/selection marker ensures sites are independently addressable. FIG. 8 shows the various arrangements of AAV, Ad5 and GOI genes following RMCE in 1 (FIG. 8A), 2 (FIG. 8B) and 3 (FIG. 8C) site CHO- and HEK293-derived SSI cells lines.

In order to generate a HEK293 SSI host, CHOK1SV derived vector integration sites and landing pad locations were BLAT searched against the human genome (version: March 2006 (NCBI36/hg18)) using a stand-alone copy of the University of California Santa Cruz (UCSC) human genome data base. This identifies sequences of 95% (and greater) similarity, in at least 25 base pairs of CHOK1SV sequence. Regions of similarity were visualized in IGV viewer (Broad institute version 2.4). Crispr-Cas9 gRNA were design using an in house Crispr-Cas9 design tool. CHOK1SV and HEK293 loci are summarized in Table A.

Example 4: Ancillary Gene Expression to Enhance rAAV Production in CHOK1SV GS-KO™

The mammalian innate immune system senses viral infection by recognizing viral signatures and activates potent antiviral responses (e.g. RIG-1 IFNα response). There is accumulating evidence that RNA silencing or RNA interference (RNAi) serves as an antiviral mechanism in mammalian cells. Mammalian viruses encode IFN antagonists such as the influenza NS1 protein and Vaccinia virus E3L protein, see e.g. de Vries et al, *Gene Ther.*, 15:545-52 (2008), which inhibit PKR, and Vaccinia virus-encoded soluble IFN-alpha/beta receptor decoys counteract the IFN response in infected cells. The co-expression of IFN antagonists can be investigated as a possible approach to overcome poor Ad5 and AAV genes expression observed in Examples 2 and 3.

Example 5: rAAV Production in CHOK1SV GS-KO™ Using Site Specific Integration

Section 1: Construction of Dual Landing Pad CHOK1SV GS-KO™ SSI Host

Figure 9:
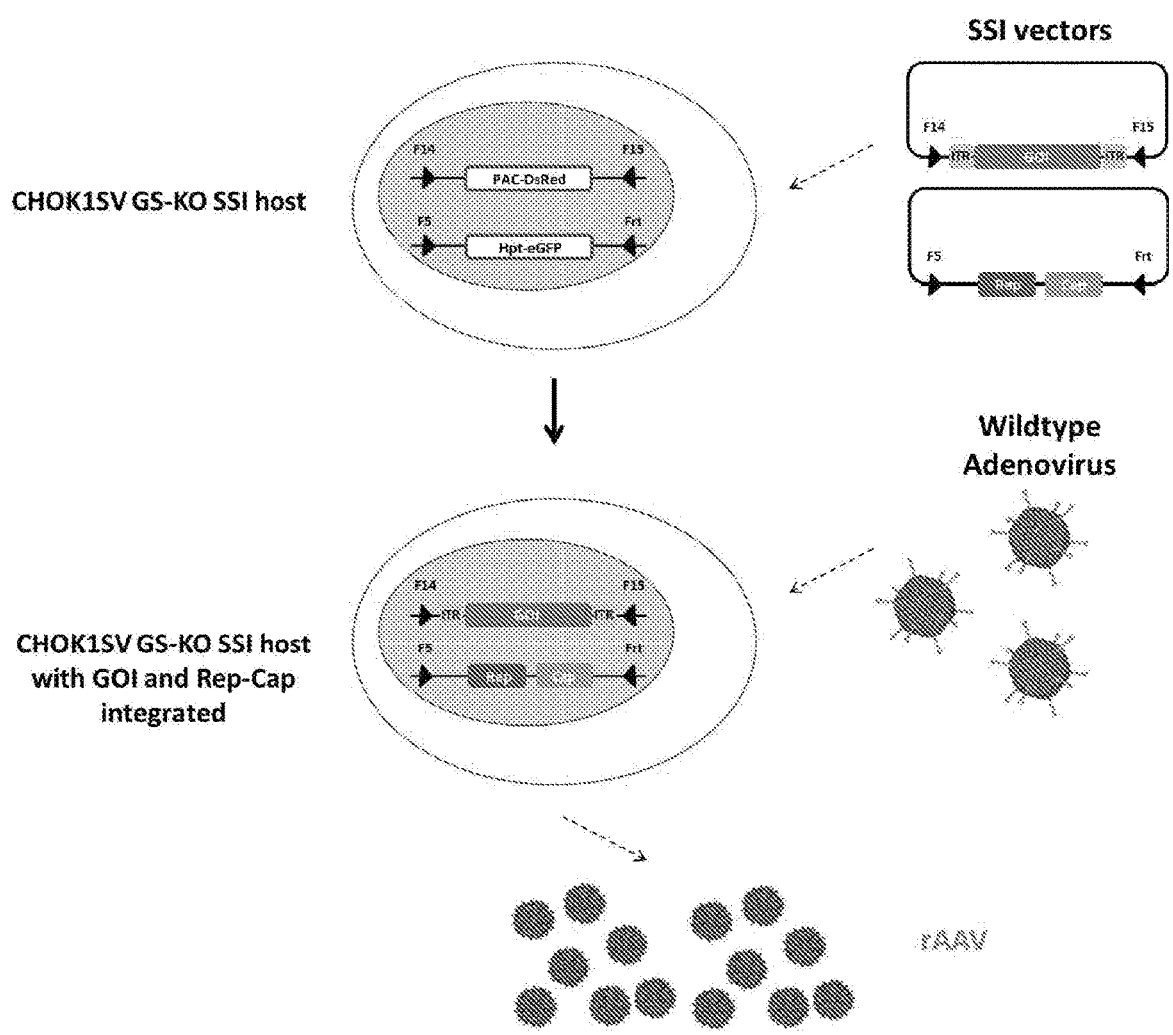
FIG. 9 shows a schematic of rAAV production in a CHOK1SV GS-KO™ site-specific integration (SSI) host utilizing site-specific integration of a GOI and Rep/Cap genes at different sites. To produce rAAV, a CHOK1SV GS-KO™ SSI host was infected with wt Ad5 to provide the helper gene functions required for rAAV replication.

The CHOK1SV GS-KO™ SSI host was created by inserting two landing pads in the genome of the CHOK1SV GS-KO™ host (FIG. 9). Landing pad A is located in the Fer1L4 gene (see Table 10) and is composed of SV40 early promoter (SV40E), hygromycin phosphotransferase-eGFP fusion gene (Hpt-eGFP) and SV40 polyadenylation sequence (pA). The Hpt-eGFP gene and SV40 pA are flanked by incompatible Frt sites (Frt_5 and Frt_wt, respectively) to facilitate RMCE of recombinant genes into the CHOK1SV GS-KO™ genome. Landing pad B is located in the NL1 locus (see Table A) and is composed of SV40 early promoter (SV40E), puromycin N-acetyltransferase-DsRed fusion gene (PAC-DsRed) and SV40 polyadenylation sequence (pA). The PAC-DsRed gene and SV40 pA are flanked by incompatible Frt sites (Frt14 and Frt1S5, respectively). In both landing pads the positioning of a Frt site between the SV40E promoter and selection marker enable it to be used in subsequent rounds of RMCE. Targeting vectors designed for RMCE in the CHOK1SV GS-KO™ SSI host contain a positive selection marker (e.g. GS) arranged immediately to the 3' of a Frt site compatible with the destination landing pad (FIG. 9). The remainder of the vector contains transcription units for the GOI followed by a Frt site compatible to the second Frt site in the landing pad.

Figure 10:
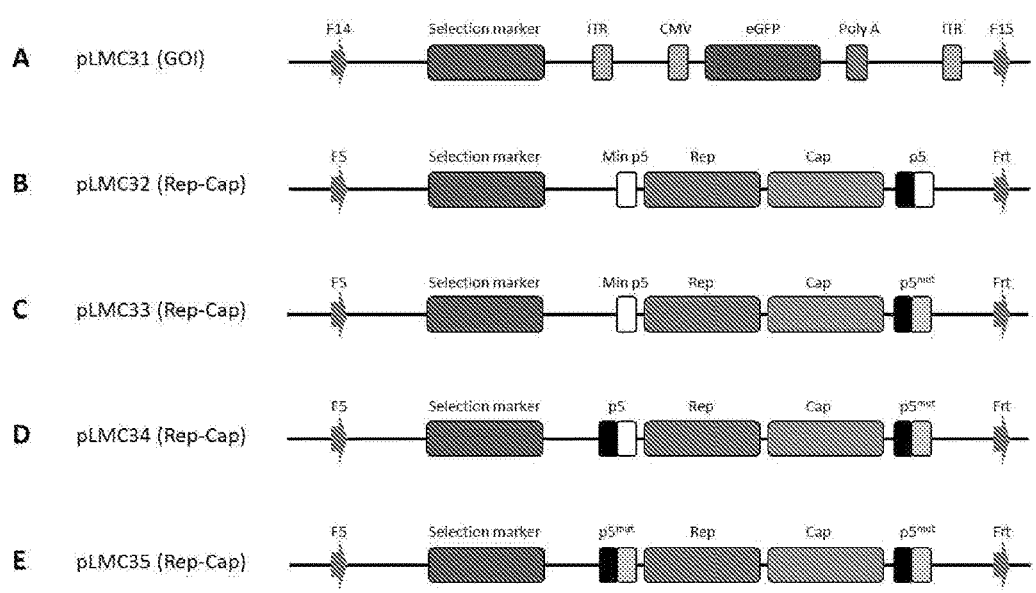
FIG. 10 shows a schematic of the GOI vector and four designs of Rep/Cap genes for site-specific integration in the CHOK1SV GS-KO™ host. All vectors were flanked by two Frt sites to allow for SSI into a CHOK1SV GS-KO™ SSI host cell.

Targeting vector DNA (FIG. 10) is co-transfected with a vector expressing Flp recombinase. Transfected cells are incubated for 24 hours and selection pressure is then applied (e.g. removal of glutamine from culture medium). Successful RMCE is marked by the loss of the Hpt-eGFP or PAC-DsRed gene and replacement with the positive selection marker gene. Cells appear dark under the fluorescent microscope or with flow cytometer analysis. Non-exchanged cells which recover in positive selection are easily removed by FACS.

Section 2: Construction of Rep-Cap and GOI Expression Vectors Compatible with the CHOK1SV GS-KO™ SSI Host To generate CHOK1SV GS-KO™ SSI host derived pools expressing both Rep-Cap and GOI genes (FIG. 9), five vectors were designed (pLMC31-35, FIG. 10A to E). pLMC31 (FIG. 10A) is a targeted vector for creating GOI (eGFP) producing cell lines in the CHOK1SV GS-KO™ SSI host. Transcription of eGFP is driven by the promoter of the hCMV major intermediate early gene 1 (hCMV) and uses a β-globin polyadenylation (pA) sequence. The entire transcription cassette is flanked by inverted terminal repeats (ITR) which are the only cis-acting elements necessary for virus replication and encapsulation. Neomycin phosphotransferase I (nptI) gene is arranged immediately to the 3' of Frt14 and successful RMCE transcription in driven by SV40E promoter located in the landing pad in the NL1 loci. pLMC32 to 35 (FIG. 10B to E) are targeting vectors containing Rep-Cap expression cassettes with different conformations of the AAV p5 promoter for creating AAV Rep-Cap producing cell lines in the CHOK1SV GS-KO™ SSI host (FIG. 10B to E). Normal Rep78 expression driven by the wild-type p5 promoter was shown to inhibit AAV production. The aim of the different conformations is to reduce Rep78 expression, while maintaining Cap expression to maximize AAV production. The glutamine synthetase (GS) cDNA is arranged immediately to the 3' of Frt5 and successful RMCE transcription is driven by SV40E promoter located in the landing pad in the Fer1L4 locus. pLMC32 (FIG. 10B) contains the minimal p5 (white square) with two of the enhancer elements removed. The full p5 (black and white square) is located in 3' of Cap gene to enhance Cap expression. pLMC33 (FIG. 10C) also has the minimal p5 promoter (white square) (similar to pLMC32) but the p5$^{mut}$ promoter (black and grey square) at the 3' of the Cap gene contains a mutated (GGGGGGG) TATA box. In pLMC34 (FIG. 10D) contains the p5 promoter (black and white square) 5' to Rep, and a p5$^{mut}$ promoter (black and grey square) with the TATA box mutated to GGGGGGG was located 3' end of Cap. pLMC35 (FIG. 10E) has the TATA mutation in both p5 promoters (black and grey square). pLMC32-35 use the GS cDNA selection marker.

Figure 11:
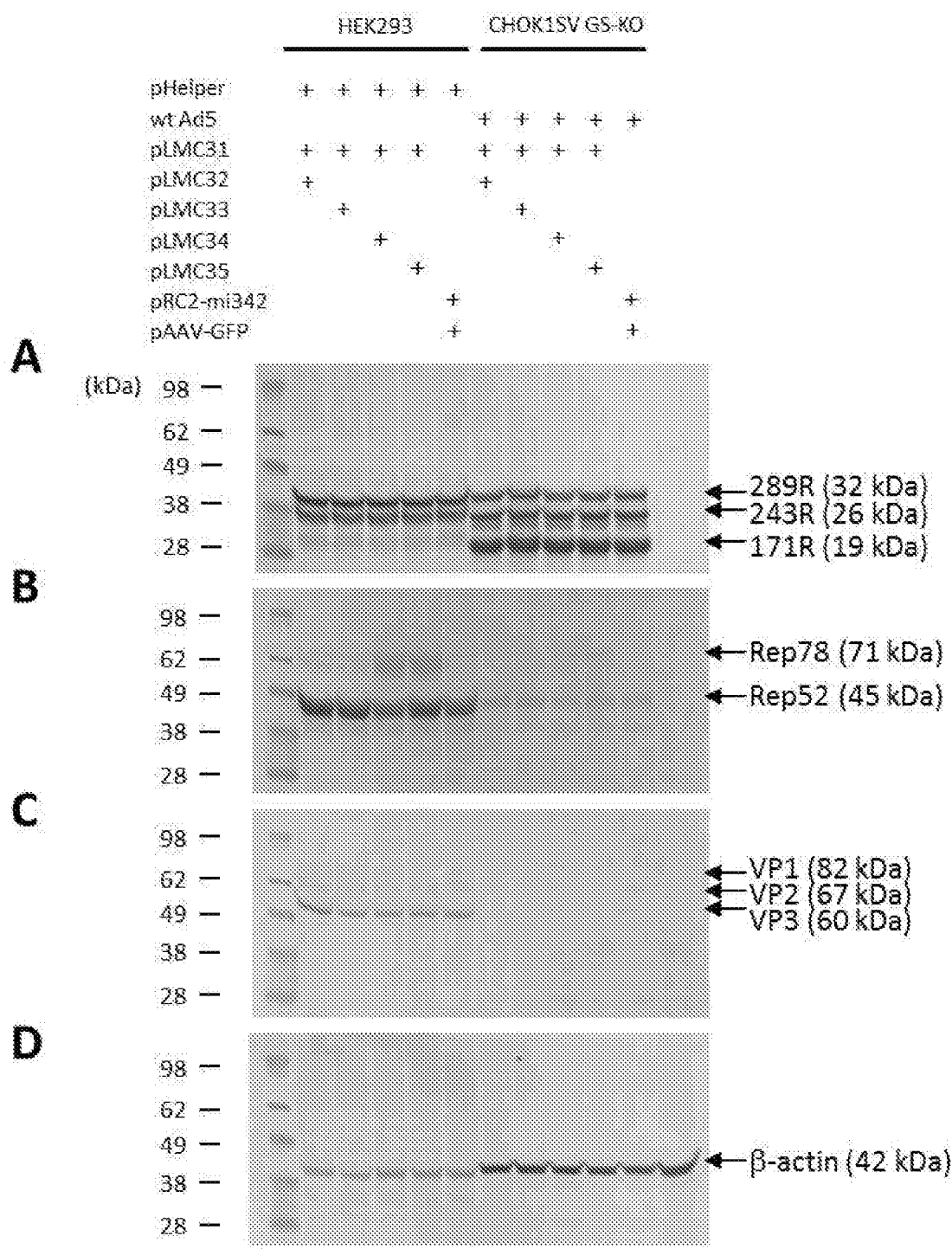
FIG. 11 shows protein expression of E1A, Rep and Cap in HEK293 and CHOK1SV GS-KO™ cells by western blot analysis. HEK293 cells were transfected with pHelper (6234, Clontech), GOI (pLMC31) and one Rep-Cap vector (pLMC32-35) or triple transfected with pHelper (6234, Clontech), pRC2-mi342 (6234, Clontech) and pAAV-GFP (AAV-400, Cell Biolabs). CHOK1SV GS-KO™ cells were infected with wt Ad5 and transfected with GOI (pLMC31) and one Rep-Cap vector (pLMC32-35) or infected with wt Ad5 and transfected with pRC2-mi342 (6234, Clontech) and pAAV-GFP (AAV-400, Cell Biolabs). Three days post transfection, the protein lysates were analysed by western blotting.
Figure 12:
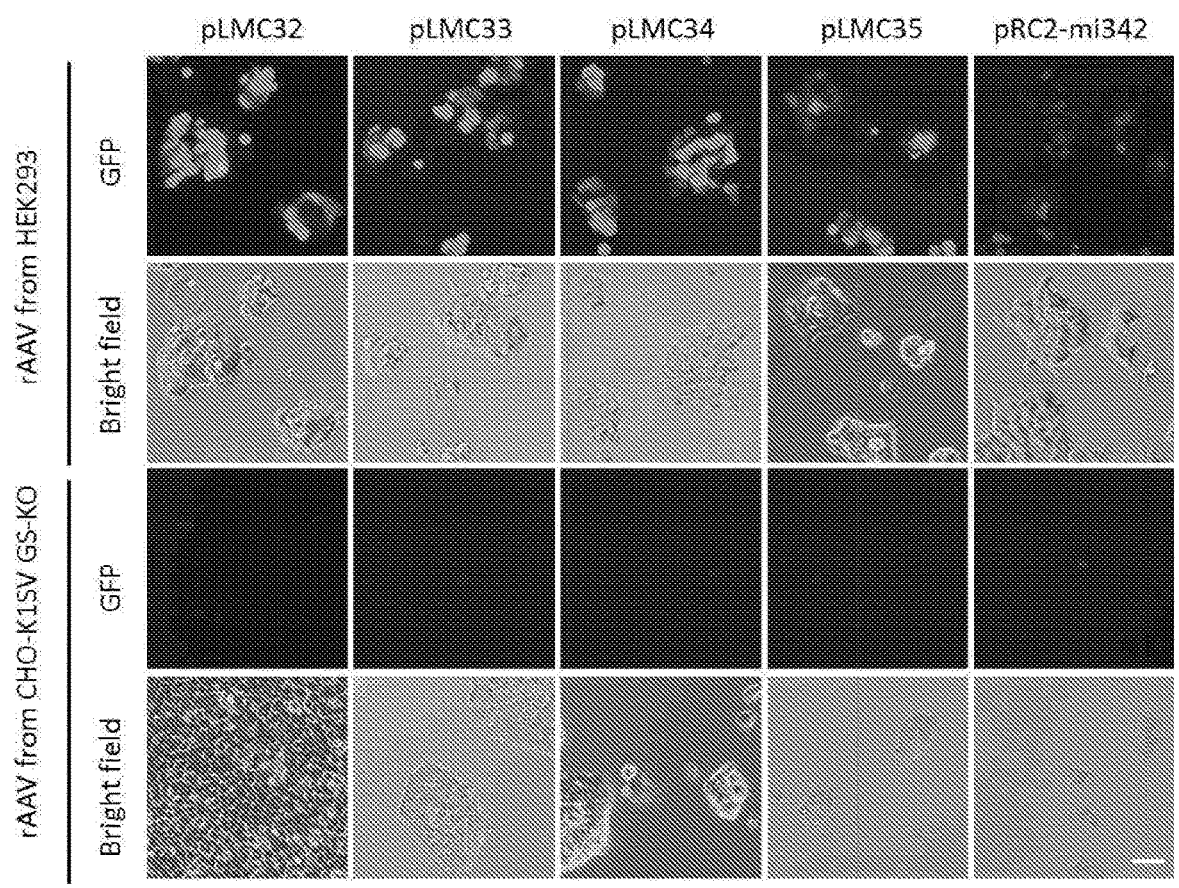
FIG. 12 shows the infectivity of rAAV produced by HEK293 and CHOK1SV GS-KO™ cells. HEK293 cells were triple transfected with Rep/Cap, GOI and pHelper (6234, Clontech). CHOK1SV GS-KO™ cells were transfected with Rep/Cap and GOI, and infected with wt Ad5. Three days post transfection, an equal volume of crude rAAV harvest was used to infect HEK293 cells. Two days post transduction, green fluorescence and bright field images were acquired. Green fluorescence is produced by the GOI-packaged rAAV. The scale bar presented represents 50 µm. The infectivity of rAAV produced by triple transfected HEK293 cells (pHelper (6234, Clontech), pRC2-mi342 (6234, Clontech), pAAV-GFP (AAV-400, Cell Biolabs)) (top panel) was higher than rAAV produced by transfected CHOK1SV GS-KO™ cells (third panel). Of note, the infectivity of rAAV produced by HEK293 cells transfected with pLMC32-35 was higher than HEK293 cells transfected with pRC2-mi342 (6234, Clontech) (top panel).

Section 3: Production of rAAV in CHOK1SV GS-KO™ and HEK293 Cells by Triple Transfection with Four Rep-Cap Configurations The ability of GOI (pLMC31) and Rep-Cap (pLMC32 to 35) expression vectors to support rAAV production in CHOK1SV GS-KO™ co-infected with wt Ad5 virus or HEK293 co-transfected with pHelper (6234, Clontech) vector. Western blot analysis confirmed the transduction of wt Ad5 in CHOK1SV GS-KO™ cells by E1A protein expression (FIG. 11A), and revealed the high level of Rep and Cap protein expression with pLMC31-35 vectors in HEK293 cells, low level of Rep protein expression and Cap protein was not detectable in CHOK1SV GS-KO™ cells (FIGS. 11B and 11C). TaqMan-qPCR analysis showed 3-5 fold increased AAV titer with these pLMC32-35 vectors compared to original plasmids from Clontech (5 #, pRC2-mi342 (6234, Clontech) and pAAV-GFP) in HEK293 cells, while the production was lower in CHOK1SV GS-KO™ cells (FIG. 20). The infectivity assay confirmed the qPCR titer, showing a high level of virus transduction for HEK293 samples and low-level infection for CHOK1SV GS-KO™ samples (FIG. 12). In summary, these data validated the functionality of pLMC32-35 vectors for AAV production in HEK293 and CHO cells, suggesting that they are capable of rAAV production in CHO cells once stably expressed.

Section 4: Generation of CHO Cells with Stable Expression of Rep-Cap and GOI by Site Specific Integration (SSI).

Figure 13:
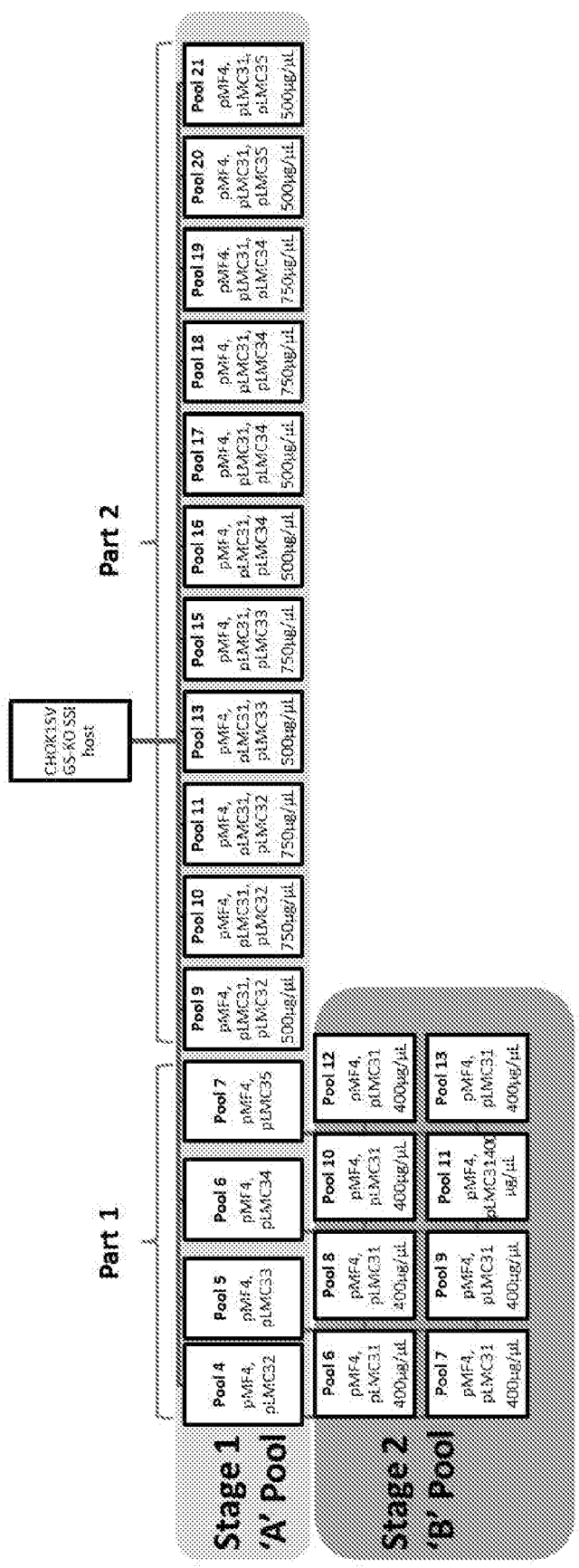
FIG. 13 shows construction of CHOK1SV GS-KO™ SSI host derived pools with SSI of GOI and one of the four Rep-Cap configurations. Pools were generated in two stages. In stage 1 part 1, the CHOK1SV GS-KO™ SSI host was transfected with FLP recombinase vector (pMF4) and one Rep-Cap vector (pLMC32-35) and then selected in glutamine-free media. In stage 1 part 2, the CHOK1SV GS-KO™ SSI host was transfected with FLP recombinase vector (pMF4), one Rep-Cap vector (pLMC32-35) and GOI vector (pLMC31), and then selected in glutamine-free media containing Geneticin (500 µg/mL or 750 µg/mL). These became 'A' Pools. In stage 2, 'A' Pools 4-7 were transfected with FLP recombinase (pMF4) and GOI vector (pLMC31), and then selected in media containing Geneticin (400 µg/mL). These became 'B' Pools.
Figure 14:
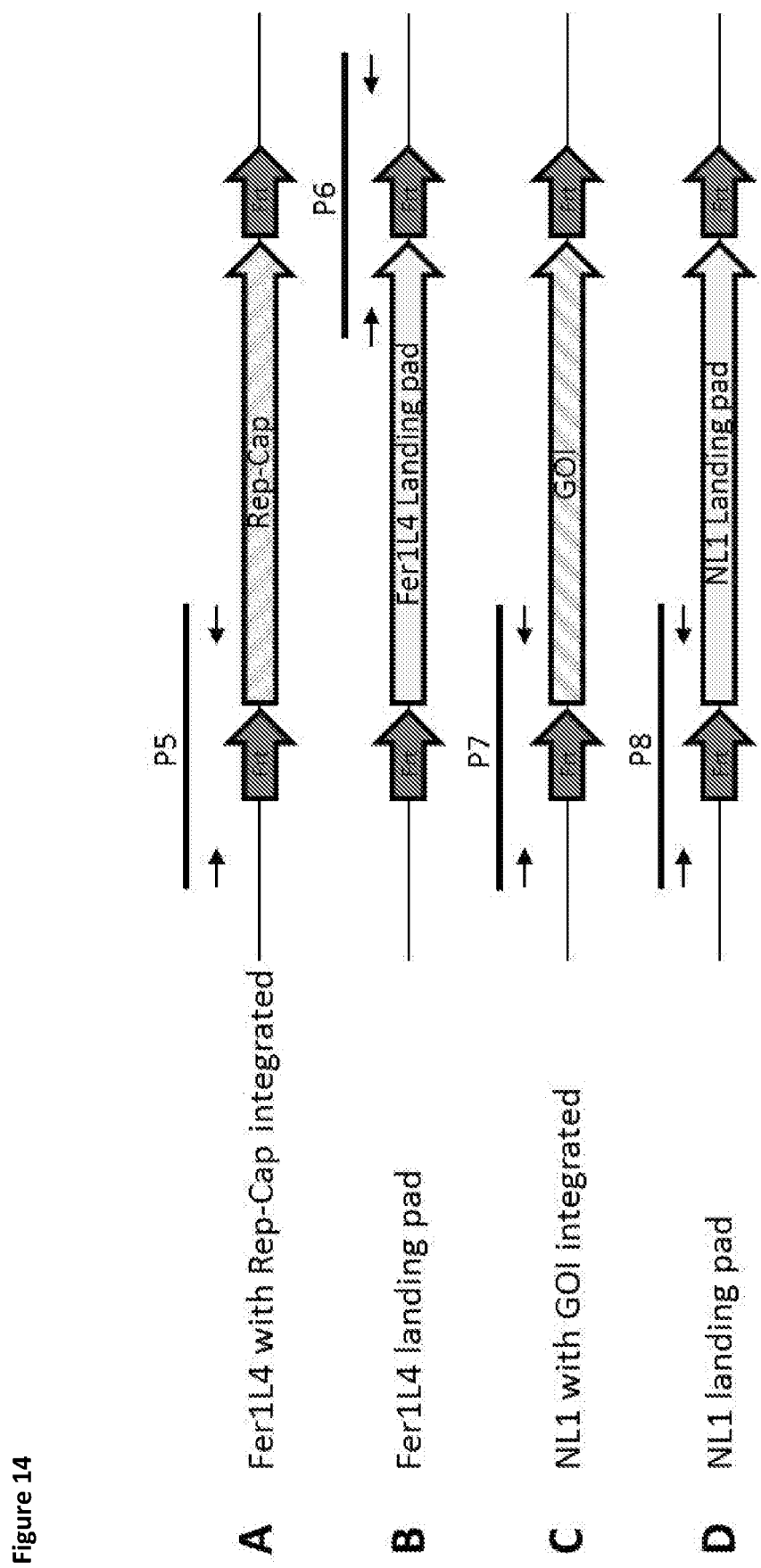
FIG. 14 shows a schematic of primer locations for detection of on-target SSI and residual (non-exchanged) landing pad. Primer set P5 was designed for detecting specific Rep/Cap integration into a landing pad located in the Fer1L4 gene. The expected product size is 1524 bp. Primer set P6 was designed for detecting residual landing pad. The expected product size is 487 bp. Primer set P7 was designed for detecting specific GOI integration into a landing pad located in the NL1 locus. The expected product size is 1446 bp. Primer set P8 was designed for detecting residual NL1 landing pad. The expected product size is 809 bp.
Figure 15:
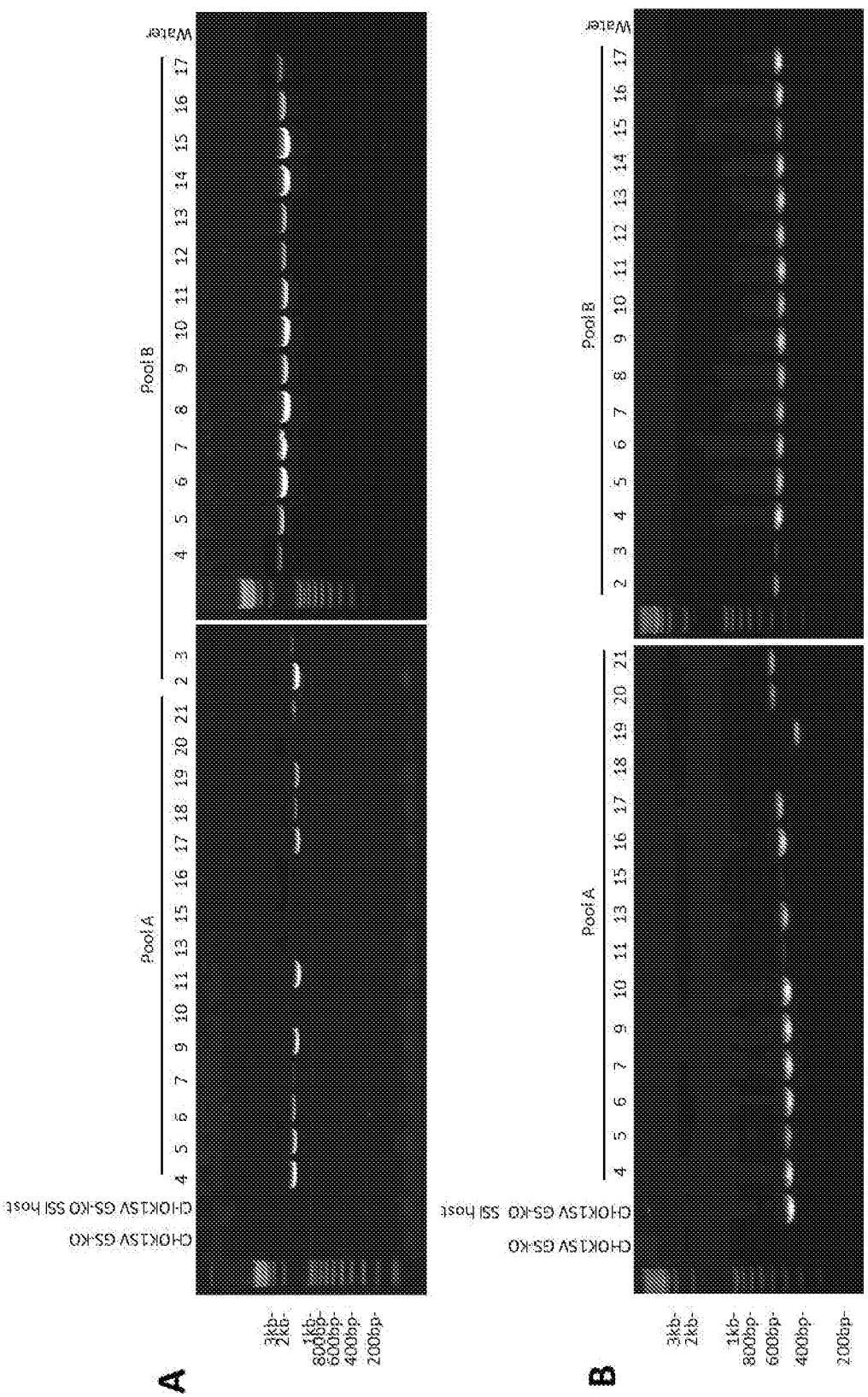
FIG. 15 shows agarose gel analysis of genomic DNA PCR products for Rep/Cap integration into the Fer1L4 landing pad. Genomic DNA was harvested from 'A' Pools, 'B' Pools, CHOK1SV GS-KO™ and CHOK1SV GS-KO™ SSI host, and then amplified using primer set 5 or 6 by PCR. PCR products were resolved by agarose gel electrophoresis.
Figure 16:
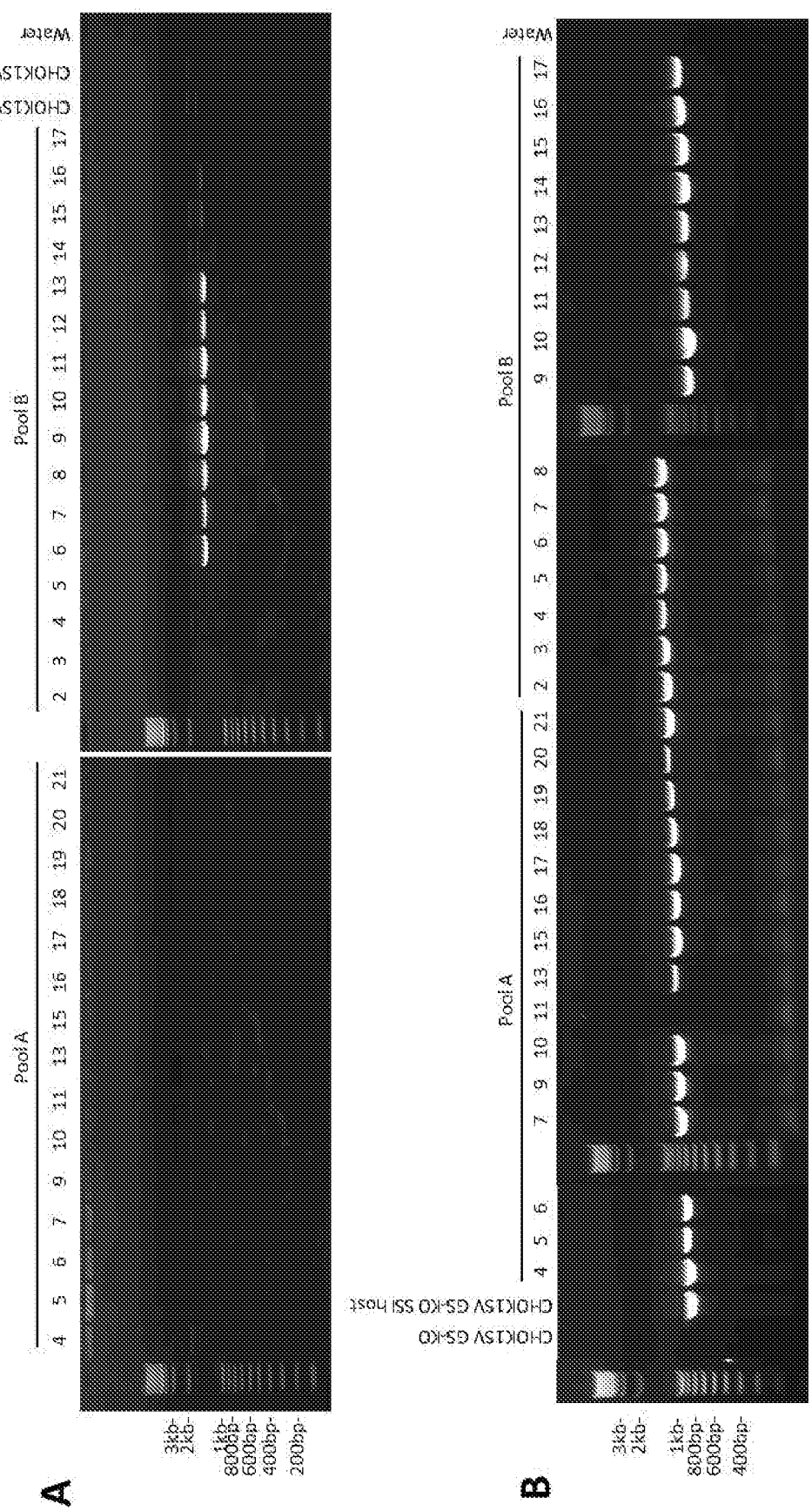
FIG. 16 shows agarose gel analysis of genomic DNA PCR products for GOI integration into the NL1 landing pad. Genomic DNA was harvested from 'A' Pools, 'B' Pools, CHOK1SV GS-KO™ and CHOK1SV GS-KO™ SSI host, and then amplified using primer set 7 or 8 by PCR. PCR products were resolved by agarose gel electrophoresis.
Figure 17:
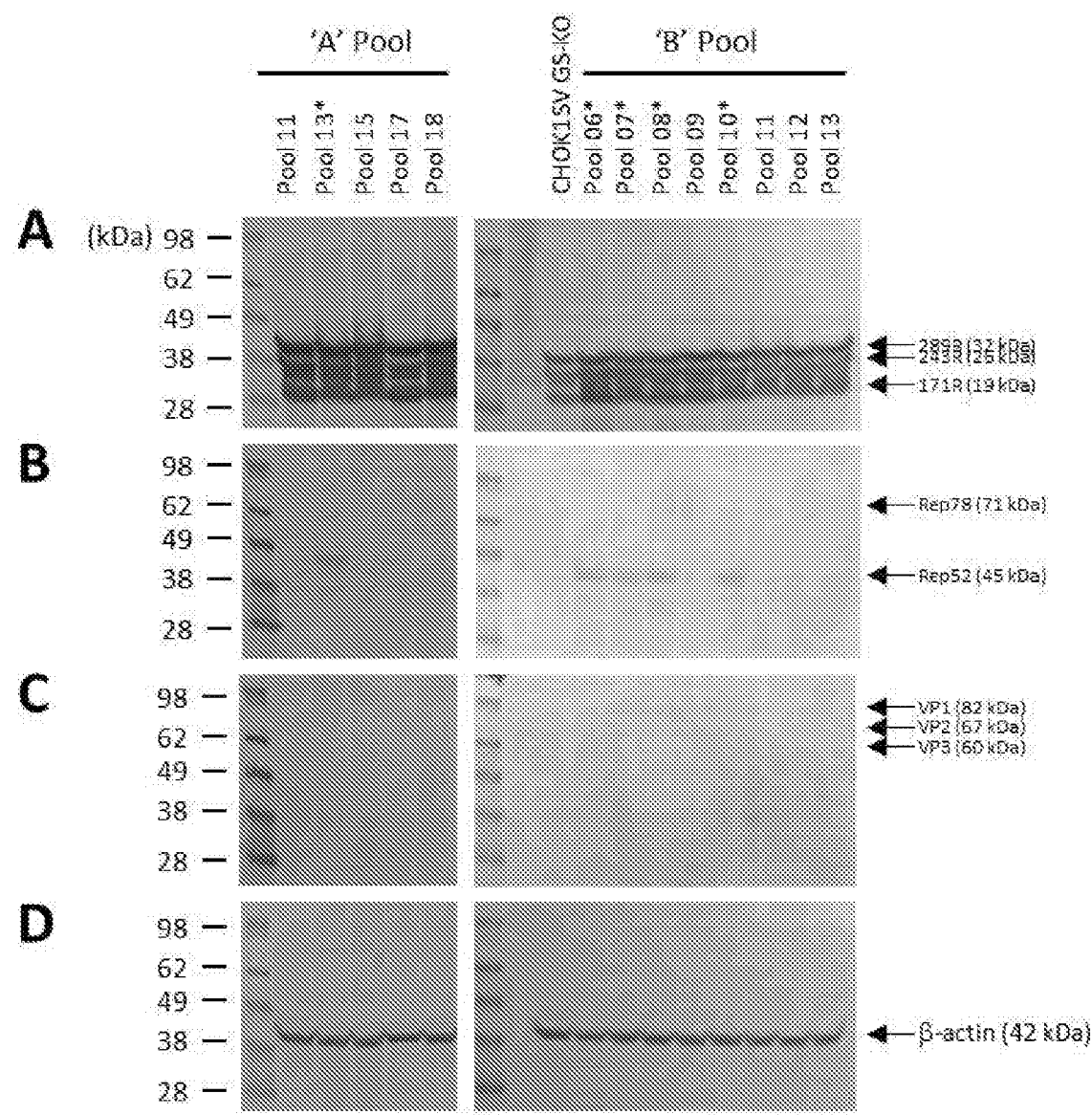
FIG. 17 shows protein expression of E A, Rep and Cap in wt Ad5 infected CHOK1SV GS-KO™ cells by western blot analysis. 'A' Pools and 'B' Pools were infected with wt Ad5 for three days, and then harvested for E1A, Rep, Cap and beta-actin protein expression analysis.
Figure 18:
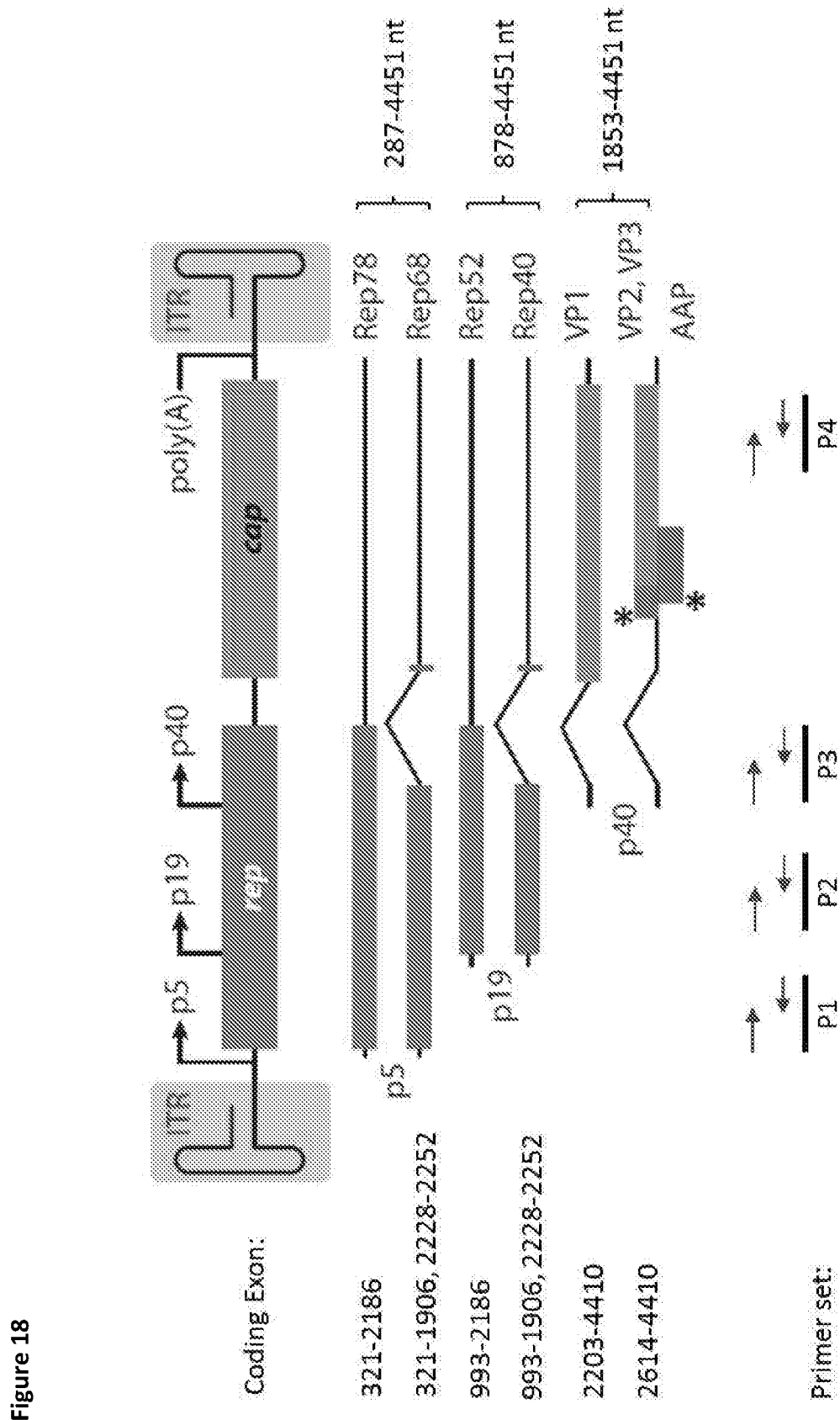
FIG. 18 shows a schematic of primer locations for detection of AAV2 Rep and Cap mRNA. Primer set P1 for Rep78 and Rep68. Primer set P2 for Rep78, Rep68, Rep52, and Rep40. Primer set P3 for Rep78 and Rep52. Primer set P4 for total Rep and Cap. * indicates the alternative ACG codon used to produce VP3. AAV2 genome structure was adapted from Samulski and Muzyczka, *Annu. Rev. Virol.* 1:427-451 (2014).
Figure 19:
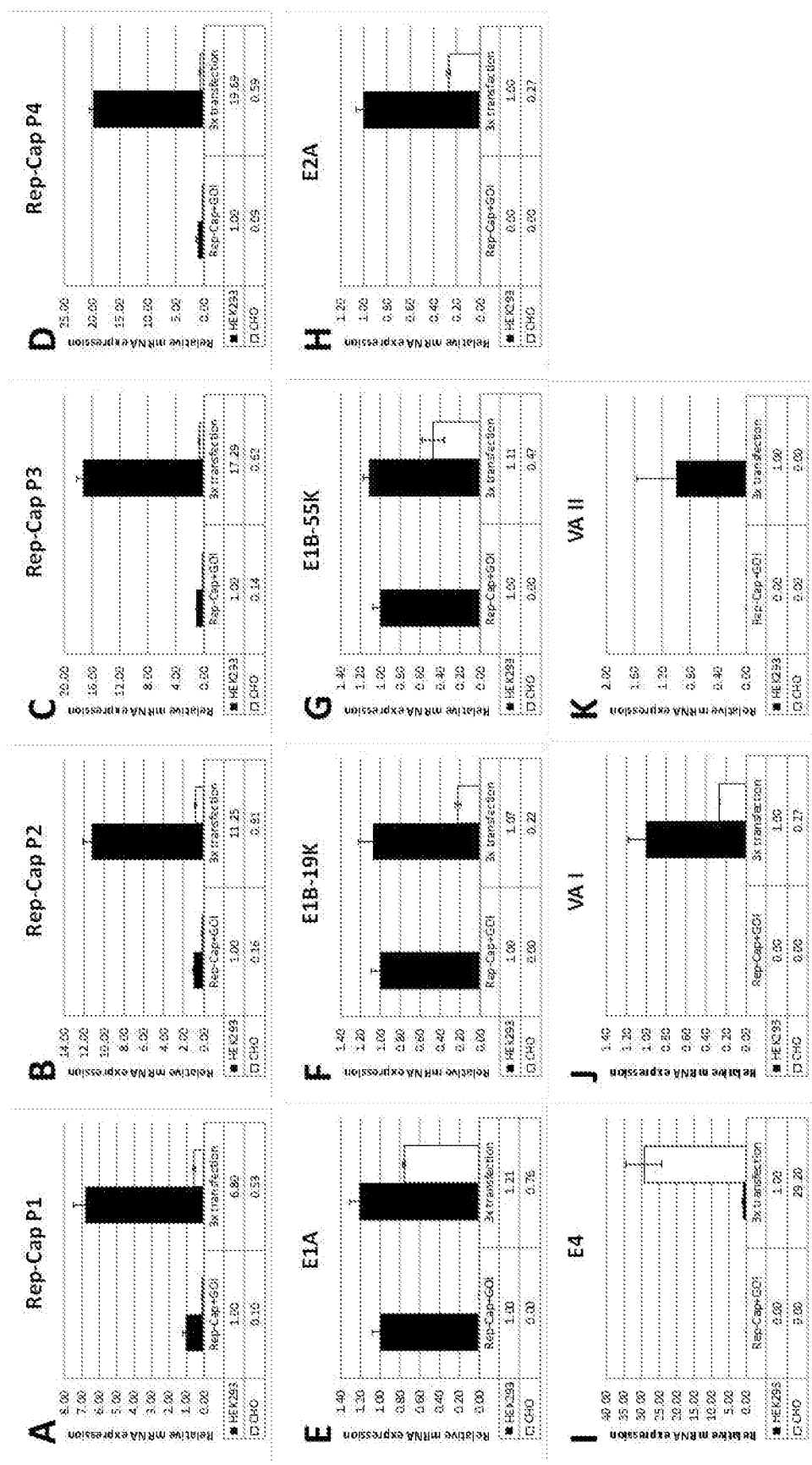
FIG. 19 shows mRNA expression analysis on Rep-Cap genes and Ad5 helper genes from transfected HEK293 and CHOK1SV GS-KO™ cells. HEK293 cells were triple transfected with pRC2-mi342 (6234, Clontech), pAAV-GFP (AAV-400, Cell Biolabs) vectors (black bars). CHOK1SV GS-KO™ cells were transfected with pRC2-mi342 and pAAV-GFP, and infected with wt Ad5 (white bars). Controls include HEK293 or CHOK1SV GS-KO™ cells transfected with pRC2-mi342 (bars on the left). cDNA was prepared for RT-qPCR analysis for Rep/Cap and Ad helper genes. Expression data was internally normalized with beta-actin and then compared to the HEK293 control sample. Primer sequences are included in FIG. 21.

To determine whether the CHOK1SV GS-KO™ SSI host with stable integration of GOI and Rep/Cap can support rAAV production, the GOI (pLMC31) and each of the Rep-Cap vectors (pLMC32-35) were transfected with FLP recombinase-expressing vector (pMF4) into the CHOK1SV GS-KO™ SSI host. Two sets of pools were generated by simultaneous or sequential integration of Rep-Cap and GOI (FIG. 13). PCR analysis using primers designed to anneal to either Rep-Cap, Fer1L landing pad, GOI or NL1 landing pad (FIG. 14) showed successful integration of Rep/Cap into a landing pad located in the Fer1L4 gene in the majority of pools (FIG. 15A). PCR products of residual Fer1L4A landing pad was detected in all, except two of the pools ('A' Pools 18 and 19), indicating complete SSI in these pools (FIG. 15B). However, GOI was only integrated into a landing pad located in the NL1 locus of pools generated by targeting sequentially ('B' Pools) (FIG. 16A), and residual landing pad was detected in all of the Pools (FIG. 16B). Western blot analysis identified five pools with stable expression of Rep, while Cap protein expression was undetectable (FIG. 17). To substantiate the Rep-Cap expression in CHOK1SV GS-KO™ cells, mRNA expression of these genes was analyzed by TaqMan-qPCR assay, using the primers for detecting different isoforms of Rep and Cap (FIG. 18 and FIG. 21). Transfection of CHOK1SV GS-KO™ cells with Rep-Cap2, GOI and pHelper (6234, Clontech) vectors induced ~5-fold higher Rep mRNA levels (FIG. 19A-C), and ~7-fold for Rep and Cap mRNA levels (FIG. 19D) in comparison with GOI (pLMC31) and Rep-Cap (pLMC32-35) vectors (FIG. 19A-C). E1A, E1B, E2A, E4 and VA I mRNA levels were only detectable when CHOK1SV GS-KO™ cells were transfected with Rep-Cap2, GOI and pHelper (6234, Clontech), and not when transfected with GOI (pLMC31) and Rep-Cap (pLMC32-35) (FIG. 19E-J). VA II mRNA levels were not detectable in CHOK1SV GS-KO™ cells (FIG. 19K). All of the observed mRNA levels, except E4 were lower in CHOK1SV GS-KO™ in comparison with HEK293 cells (FIG. 19A-K). These data show that the Rep-Cap mRNA induction and expression were lower in CHOK1SV GS-KO™ cells in comparison with HEK293 cells. In summary, CHOK1SV GS-KO™ cells can express Ad5 helper genes and Rep-Cap, but the expression levels of these genes need to be further optimized.

SEQUENCE LISTING (74 sequences)

SEQ ID NO: 1 - DNA, 34 bp, Artificial Sequence
  source: /note="Description of Artificial Sequence: Synthetic oligonucleotide"
ataacttcgtataatgtatgctatacgaagttat

SEQ ID NO: 2 - DNA, 34 bp, Artificial Sequence
  source: /note="Description of Artificial Sequence: Synthetic oligonucleotide"
ataacttcgtataatgtatactatacgaagttat

SEQ ID NO: 3 - DNA, 34 bp, Artificial Sequence
  source: /note="Description of Artificial Sequence: Synthetic oligonucleotide"
ataacttcgtataaagtatcctatacgaagttat

SEQ ID NO: 4 - DNA, 34 bp, Artificial Sequence
  source: /note="Description of Artificial Sequence: Synthetic oligonucleotide"
ataacttcgtataatgtgtactatacgaagttat

SEQ ID NO: 5 - DNA, 34 bp, Artificial Sequence
  source: /note="Description of Artificial Sequence: Synthetic oligonucleotide"
ataacttcgtataggatactttatacgaagttat

SEQ ID NO: 6 - DNA, 34 bp, Artificial Sequence; identical to SEQ ID NO: 1
  source: /note="Description of Artificial Sequence: Synthetic oligonucleotide"

SEQ ID NO: 7 - DNA, 48 bp, Artificial Sequence
  source: /note="Description of Artificial Sequence: Synthetic oligonucleotide"
gaagttactattccgaagttcctattctctagaaagtataggaacttc

SEQ ID NO: 8 - DNA, 48 bp, Artificial Sequence
  source: /note="Description of Artificial Sequence: Synthetic oligonucleotide"
gaagttactattccgaagttcctattctctagatagtataggaacttc

SEQ ID NO: 9 - DNA, 48 bp, Artificial Sequence
  source: /note="Description of Artificial Sequence: Synthetic oligonucleotide"
gaagttactattccgaagttcctattctctacttagtataggaacttc

SEQ ID NO: 10 - DNA, 48 bp, Artificial Sequence
  source: /note="Description of Artificial Sequence: Synthetic oligonucleotide"
gaagttactattccgaagttcctattcttcaaatagtataggaacttc

SEQ ID NO: 11 - DNA, 48 bp, Artificial Sequence
  source: /note="Description of Artificial Sequence: Synthetic oligonucleotide"
gaagttactattccgaagttcctattctctagaaggtataggaacttc

SEQ ID NO: 12 - DNA, 48 bp, Artificial Sequence
  source: /note="Description of Artificial Sequence: Synthetic oligonucleotide"
gaagttcctattccgaagttcctattcttcaaaaggtataggaacttc

SEQ ID NO: 13 - DNA, 48 bp, Artificial Sequence
  source: /note="Description of Artificial Sequence: Synthetic oligonucleotide"
gaagttcctattccgaagttcctattcttcaaaaagtataggaacttc

SEQ ID NO: 14 - DNA, 48 bp, Artificial Sequence
  source: /note="Description of Artificial Sequence: Synthetic oligonucleotide"
gaagttcctattccgaagttcctattcttcaataagtataggaacttc

SEQ ID NO: 15 - DNA, 48 bp, Artificial Sequence
  source: /note="Description of Artificial Sequence: Synthetic oligonucleotide"
gaagttcctattccgaagttcctattctatcagaagtataggaacttc

SEQ ID NO: 16 - DNA, 48 bp, Artificial Sequence
  source: /note="Description of Artificial Sequence: Synthetic oligonucleotide"
gaagttcctattccgaagttcctattcttataggagtataggaacttc

SEQ ID NO: 17 - DNA, 48 bp, Artificial Sequence
  source: /note="Description of Artificial Sequence: Synthetic oligonucleotide"
gaagttactattccgaagttcctatactttctggagaataggaacttc

SEQ ID NO: 18 - DNA, 48 bp, Artificial Sequence
  source: /note="Description of Artificial Sequence: Synthetic oligonucleotide"
gaagttactattccgaagttcctatactctccagagaataggaacttc

SEQ ID NO: 19 - DNA, 48 bp, Artificial Sequence
  source: /note="Description of Artificial Sequence: Synthetic oligonucleotide"
gaagttactattccgaagttcctatactatctacagaataggaacttc

SEQ ID NO: 20 - DNA, 48 bp, Artificial Sequence
  source: /note="Description of Artificial Sequence: Synthetic oligonucleotide"
gaagttactattccgaagttcctatactctctggagaataggaacttc

SEQ ID NO: 21 - DNA, 48 bp, Artificial Sequence
  source: /note="Description of Artificial Sequence: Synthetic oligonucleotide"
gaagttactattccgaagttcctatactatcttgagaataggaacttc

SEQ ID NO: 22 - DNA, 32 bp, Artificial Sequence
  source: /note="Description of Artificial Sequence: Synthetic oligonucleotide"
taactttaaataatgccaattatttaaagtta

SEQ ID NO: 23 - DNA, 32 bp, Artificial Sequence
  source: /note="Description of Artificial Sequence: Synthetic oligonucleotide"
taactttaaataattggcattatttaaagtta

SEQ ID NO: 24 - DNA, 52 bp, Artificial Sequence
  source: /note="Description of Artificial Sequence: Synthetic oligonucleotide"
catcagggcggtcaggccgtagatgtggaagaacggcagcacggcgaggacg

SEQ ID NO: 25 - DNA, 52 bp, Artificial Sequence
  source: /note="Description of Artificial Sequence: Synthetic oligonucleotide"
atgtggtcctttagatccactgacgtgggtcagtgtctctaaaggactcgcg

SEQ ID NO: 26 - DNA, 52 bp, Artificial Sequence
  source: /note="Description of Artificial Sequence: Synthetic oligonucleotide"
catcagggcggtcaggccgtagatgtgggtcagtgtctctaaaggactcgcg

SEQ ID NO: 27 - DNA, 52 bp, Artificial Sequence
  source: /note="Description of Artificial Sequence: Synthetic oligonucleotide"
atgtggtcctttagatccactgacgtggaagaacggcagcacggcgaggacg

SEQ ID NO: 28 - DNA, 34 bp, Artificial Sequence
  source: /note="Description of Artificial Sequence: Synthetic oligonucleotide"
acaacttcgtataatgtatgctatacgaagttat

SEQ ID NO: 29 - DNA, 34 bp, Artificial Sequence
  source: /note="Description of Artificial Sequence: Synthetic oligonucleotide"
taccgttcgtatagtatagtatatacgaagttat

SEQ ID NO: 30 - DNA, 34 bp, Artificial Sequence
  source: /note="Description of Artificial Sequence: Synthetic oligonucleotide"
taccgttcgtatagtatagtatatacgaacggta

SEQ ID NO: 31 - DNA, 1951187 bp, Cricetulus griseus
  modified_base (52172)..(52214): a, c, t, g, unknown or other
  modified_base (79001)..(79313): a, c, t, g, unknown or other
  modified_base (108056)..(108564): a, c, t, g, unknown or other
  modified_base (114171)..(114194): a, c, t, g, unknown or other
  modified_base (124957)..(125001): a, c, t, g, unknown or other
  modified_base (133924)..(133933): a, c, t, g, unknown or other
  modified_base (220464)..(220571): a, c, t, g, unknown or other
  modified_base (239660)..(240268): a, c, t, g, unknown or other
  modified_base (291831)..(292319): a, c, t, g, unknown or other
  modified_base (321827)..(321996): a, c, t, g, unknown or other
  modified_base (322776)..(322794): a, c, t, g, unknown or other
  modified_base (327260)..(327294): a, c, t, g, unknown or other
  modified_base (352837)..(353013): a, c, t, g, unknown or other
  modified_base (369896)..(371164): a, c, t, g, unknown or other
  modified_base (399674)..(399863): a, c, t, g, unknown or other
  modified_base (406226)..(406576): a, c, t, g, unknown or other
  modified_base (453719)..(453892): a, c, t, g, unknown or other
  modified_base (454054)..(454253): a, c, t, g, unknown or other
  modified_base (495499)..(496477): a, c, t, g, unknown or other
  modified_base (519979)..(521245): a, c, t, g, unknown or other
  modified_base (582983)..(583123): a, c, t, g, unknown or other
  modified_base (616775)..(616812): a, c, t, g, unknown or other
  modified_base (624906)..(624971): a, c, t, g, unknown or other
  modified_base (639489)..(642305): a, c, t, g, unknown or other
  modified_base (719672)..(719704): a, c, t, g, unknown or other
  modified_base (720531)..(720727): a, c, t, g, unknown or other
  modified_base (726029)..(726071): a, c, t, g, unknown or other
  modified_base (727693)..(727822): a, c, t, g, unknown or other
  modified_base (782249)..(782395): a, c, t, g, unknown or other
  modified_base (851142)..(851163): a, c, t, g, unknown or other
  modified_base (891452)..(891678): a, c, t, g, unknown or other
  modified_base (915448)..(915498): a, c, t, g, unknown or other
  modified_base (941764)..(942265): a, c, t, g, unknown or other
  modified_base (1031556)..(1032172): a, c, t, g, unknown or other
  modified_base (1048641)..(1048698): a, c, t, g, unknown or other
  modified_base (1050767)..(1051047): a, c, t, g, unknown or other
  modified_base (1056545)..(1056666): a, c, t, g, unknown or other
  modified_base (1143444)..(1144121): a, c, t, g, unknown or other
  modified_base (1156625)..(1156734): a, c, t, g, unknown or other
  modified_base (1175145)..(1175329): a, c, t, g, unknown or other
  modified_base (1265159)..(1265181): a, c, t, g, unknown or other
  modified_base (1299864)..(1299992): a, c, t, g, unknown or other
  modified_base (1301977)..(1302157): a, c, t, g, unknown or other
  modified_base (1334798)..(1336039): a, c, t, g, unknown or other
  modified_base (1336397)..(1337755): a, c, t, g, unknown or other
  modified_base (1337935)..(1338890): a, c, t, g, unknown or other
  modified_base (1386211)..(1388539): a, c, t, g, unknown or other
  modified_base (1441387)..(1441514): a, c, t, g, unknown or other
  modified_base (1452638)..(1453257): a, c, t, g, unknown or other
  modified_base (1460781)..(1460828): a, c, t, g, unknown or other
  modified_base (1471004)..(1471013): a, c, t, g, unknown or other
  modified_base (1473989)..(1475484): a, c, t, g, unknown or other
  modified_base (1476799)..(1477339): a, c, t, g, unknown or other
  modified_base (1482117)..(1482212): a, c, t, g, unknown or other
  modified_base (1542738)..(1542780): a, c, t, g, unknown or other
  modified_base (1575935)..(1576259): a, c, t, g, unknown or other
  modified_base (1625182)..(1625435): a, c, t, g, unknown or other
  modified_base (1658452)..(1660406): a, c, t, g, unknown or other
  modified_base (1660985)..(1661024): a, c, t, g, unknown or other
  modified_base (1774223)..(1774271): a, c, t, g, unknown or other
  modified_base (1793329)..(1793818): a, c, t, g, unknown or other
  modified_base (1858210)..(1858223): a, c, t, g, unknown or other
  modified_base (1861362)..(1861398): a, c, t, g, unknown or other
  modified_base (1909232)..(1910030): a, c, t, g, unknown or other
  modified_base (1920861)..(1920951): a, c, t, g, unknown or other
  modified_base (1933768)..(1933896): a, c, t, g, unknown or other
tcattttcatgaagatgtttttaaggtcattctcttctgcatcatctgcgttgtggtgttcaggtcttgctggtgtagggtctctagactcgagtggtgtcatattggtttttctgttgttgaatgtgtttttatattgtcttcttcacatcctttcttccagtgggtatagaaggattctcttcctctcctagtctggtggatggaggcaggactggcaccggagacccggaagtccttggatgtgctggatcctgtggaactgagatctgctgtgtgcagccctctggcatcaggttaccccaggcagggcagaagaagaaacccaccttcctttttttgtaagattttatttatttatttatttatttatttatttatttatttggtaattgattgattgattgactgactgactgattggttgattgattaattgatacaacattctgtctccacatatgcttgcacgccagaagagggcaccagatctcattacagatggttgtgagccaccatgtgattgctgggaattgaactcaggacctctggacgagccagtgctcttaacctctgagccatctctccagcccccgaaacccgccttcttttacttgaagattctccttgatgtcttctgagttcttctacttgctttctttttgtaacatatttactctatcattctgtgtcttacttaaggttatatcattgttgtgacgatacaccatgaccaaaagcaacttgggaatctacaagagtgaccctattgaaaactcctagtaatgggaaatatggagcttggaccagccaccttccgtaaccaggcaaggcttccttccagtggagggactgggacaccaacctagccacaaaaacttcaatctacaatctgtcctgtctgcaagatgtgctgtagtaaagctggcacagaacatgtgggagtggccaaccaatgactggtccaacttaagacccttgccacagagggagcccaagcctgaacctgtctggagggctaggacccagaggctggatagcccagaaacgtaagatagaaccaaacatgaacaccccgcccccaaaaaagtcaatgagccggatactggctagttgcctcatccagccttaatatgagagggtgtgcatagtctcattgcaacatttacaacaagatatgccacgttttcttgatatctctgaaggcctggccttttctgaagggaaatggaggaggagtcgatctgggagaaagggaaggtgggggaagggactggaggagaggagggaggggaaactgcagtcaggatgtaatatatgagagaataaaaatttaaataaagtagaaaaataaaaagaaaatgattcctgccaataaactgttatttgagtgactgcaaaaaagaaaaagaaaaagaataaaagaacttctaaccattataggatatagtagaaagaaagaaagaaagaaagaaagaaagaaagaaagaaagaaagaaagaaagaaagaatgtttaagcattactgatggcaatataaaaaaaaaaacacttccatcacttttggatagcagaatggctattcctcaaaagctaaatgaagacgtagcatactgcccaccaattccactcctgcttaaacttaaagactgaaaagaaaatactcaaataaactctgaacatatcattcacagcagctatatgaacaatatcaaaagacgtaaaatactcaaatgttcatttctggatggataagcaaaggtgttatctacatgcaatgggatattatttagccatgaaatgtaactgataaatgctgcaatgtggatgaacctaaataaaacactacactaagtgaacaaagaaaaaccttaaaaggtcacttatttctcattctttgaggcagggggtcaaaactggtctcaaacttgctagtagtagtccaggccgctctttacagcctgcttcctgtgtactagaaatacaagtgtgtgccaccatgcccaatttgatgccacattaataatttccatttatctgaaatgttcagataagcaatctatacaacacaaaatgcataaagctgttaaccaggggtttggggtgactactaacaaggacaaggtttctctctagagtctagaaaatgttctcaatgaacaacagtgatggctgaagtttataattatgctacaaacactaaactgcatatatcaaaataataacccactccacaaagttgtcctcagacccccaggtggcttctataacagacaaacataaatgtgtgagcaacacacagacatgtacatatgtacacacagaatccttttccagagaggaaagaagaaaggagctaagggtatatctttttatctttttttttcaagacatggtttctctgtgtagcactggctatcctggaactcattctgtagaccaggatggcctctaattcacagagatccacctgactctgccttctgggttaaaggtgtgtgccttgctaagggtatattttttgttttgttttttgagacggtttctctgtggctttggaggctgccctggaactagctcttgtagaccaggctggcctcgaactcacagagatcctctgcatctgcctctgcctcccgagtgctgggattaaaggcgtgtgccaccaatgctcggccctaacagtatatcttgatgactctgtagtaagcacacaagaggccctgagttcaatctccagcaccaaaaaaaaaaaaaaaaaaaaaaaaaaaaaaaaaaaggagaaaaaaaggggaaggggggaagcaagagagaagaggatatctggctatacatataacatctatttcatagatttcaaaacaaacaatattattcaggacaaagaaagtaattctagatgggcagtggtagagcacgcctttaatcccagcgctcgggaggcagaggcaggtggatctctgtgagttcgaggccagcctgttctacaagagcgagtgccaggatagtctccaaagctacacagagaaaccctgtctcgaaaaaccaaaaaaaaaaaaaaaaaagtaattctaaaatgataacgataatagtcaatgaacaagggaacatatgaatcctgtttattcacataggcaaaaagcttcaaagtacttgagacaaaacatggtagcaagtgcatcaaaattgcagcaaacacacattgaattcaatgactctcagtcaacagaagaacttgggggataaaaaggacattagagctttgaacaatatcctgaattagctgacatttgtgaaattcttgtcttagttacagatccggtacctgtgaagaagtgcttggataaaagcaattaaagggagaaggggtctaccttagctcactgatcatgaggtagaagtcacagaagtgggggtgttggaaaacagctcaagagagactgatacaccatgaagacagagctcacatggagagtttttttttattggggggaagggagaaagggcaagagaaagagagtgtagagcagcctcatgggaaaagagaaagaggtacaaagatgcagagacagagaggcagagaggcagacacagagaggtagagaggcagagagagagagagagagagagagagagagagatgaatactgggagacagagagagaggcagagaggcagagaggcagagaaagaggacatgggcaggccatgacttttaaaggggacgtagctatagtgaagtagctgatgacgttgtcaggaccttgagcaggtcagagtactgactgagtactggccagcacatcctgccaggtgacagggagcaggccagcataatgcctgaatggaaaactaatgctagcactcaactagctttctactttaatacagcccagagtgctatcactgtgtgtgtgtgtgtgtgtgtgtgtgtgtgtgtgtgtgtgtgtatgtgtgtgtgtgtgtgtgtgtgttggtgttttgcctgcatgtatatctctatgggggtgtcagattccttggaactggagttacagacagttgtgatctgccttgtgggtgctgggaattgaacccaggccctctggaagaacagccagtgcttttagatgctgagccatctctccagcctggtgctaaccacttttagggcgagttttttccacctcaaataacctaatccaagtgtgtccagaagctcaaccccaggtgactctacatattgtcaagttgctaatcaatattaacaatcacaagtctttacccagtaaccgaatacatattcttgtcaagtgtgcaacaaaaatgcaccaagacacattttattcagagtcactaaacaaacctcagcaaaggcaatatgtatattctctgattacaatggaattcaattggaaatcaggaacacaactcagaaaaaaaatcctcaaatatatcaaaattagaaacctagtattgagctgggcagtggtggtgcatgcctttaatcccagcactcaggaagcagaggcagatagatctctgagttcaaaactagcctggtctacagagaaagttccagaatactcagaggtacacagacaaaccctaagggggagggggagaaacctagtgttaactagcccctgaggcaaagaagaaataaaagggaaagttaaaaggaactttaactgaacttgatgacaaacatgatgaatttgtacagattcttcctcggcttcccaaatgacagcattataggtgtgggtcaccatgccctgcttctcctgacatttttgggagcacagagagtttgggttcagattttgtccaataatttcctaaaagctggcttaacacttgtgcctcatccttgggcatctcctccccattactgggaagaaggggtgtttgtcaccagctaggtaagcttcatttcctggcttcctgtggtcctgctggcttcccagaaaggagacagtttctctggctgacacatggtggtatcgttctcttgttaatgcatattagttttattttatatttctgtgcttatgaatatttagcgtgtacctatgccattacaaaaaaagttaccgaagtgagatacatatagctttgaaataagacagaaatcacaagattgaagatttggttcagagattagcataaagccctaggtttgatccctagtctcaaaacaacacaacagaaaacaggaacaaaatagggaaattcagccaggagttggtggtgcatgcctttaatcccagcactttggaggcaaaggcaggaggagctctgtgagtttgaggccagcctggtctacagagctagctccaggacacccagggctacacaaaggaaccctgtcacaaaaaaaaaaaagaagattctataggacacggtttgttccctgatggaatacctgttgcaactgttactagtatctgtaagtgggccatggccattggttggaaaagaatgtcataccacttgttctggctctagtgtttcaggaatatttggaaatattacaaactataaaaatgttgtttaatagctggacggtgggaacccatgcctttagcactcaggcaaatccctgtgagtttgagaccagcctggtctactgagtgagttccaagacaaccagggttacacagagaaaccgcctcaacaatattgtttaataaatgatttgggggagtggaataaaagggttgtaacatgaaaatccatgagagagactgcaaaggaacacaagaaatacttcagactgatgaacacagccagtgtttgatttaagaagtgtcacagatatacacatgtcaaaacttaccaagtcaaggggctggttaagagtactttccctcttgcagaggacctgagttcaatcaacattgcaagcatagtgactcacaaccagctgtaacttcagtttcatggaatctgttacagctaatcttggttgtcagagtgactggatcacctaaaacataagctactgagtattctgtgaggccttttcttagtcaggttatttgaagcaggaagatccaccctaaaagtgggtaacaccttctggtggcaacctagataagaagacctgggagaaggaaacattggtttttgcctgcttgccctcactctcactggcaagtttatttatcctgttgctgtgccattccttcttcaatattagaaactactctgagcttccaaaatagactgaagcagggcatgggtggcccacacctttaatcccagcactccggaggcagaggcaggaggatctctgtgagttggaggccagcctggtctacagagcgagtgccacgataggctccaaagctacatagagaaaccctgtctcaaaagagagagaaagagagagagagagaaaaaaccaatatagattgaagatcagcagctattcaggaaccctccagacctccaatgtcagattaggactactgtgacacctagcttcaagtactgagccactacaggataggactctccagtttattatggactcattctctgggatggtaagccaaaataaactcttccataagctgttttggtcatggtgttttatcatatcaacaaaaagtaacttaaacagaagttggcaacagaaagtgatttactgccatgaagaacatgaccatgatttttgtaaaaggctttttcttttgggccaccaaccagctcccaaatcaagacacagagacttgctgaagatgctttcttttttccattgtacaattttggcttctttgtcaagtatcaggtgttcataggtgtgtggattaatatctgtgtcttcaattccattgatccacatatctgtttttatgccaataccaagctgtttttattattatagctttatagtagagcttgaagtcaatgatggtgatgcctctagaagttcctttattgcacagggttgttttggctatcctgggttttgtgtttttccacacaaacttgagtattattctttccaggtctgtgaagaattgtgctgggattttgatggagattgcattgaatctgtagattgcttttgttaagattaccatttttactatgttgatcctacctatccaagagcatgggagatttttccattttctgatatcttcttcaatttctttcttcaaagacttaaaagttcttctcatgcaggtctttcacttgtttagtgagagtgagggaaatgtttctctgatttctttctcatccaatttatcatttgtatatagggggctactgattttttttagtttatcttgtaccttgctgtagggagaaaccctgattagatgtaccgctgaccacgcctacttgggcgtggccacagttacataacaggggtttaagaagcagggaggcaagaatgaggctctctctggcttgactgaactgactgggaagcatttctgggtctgtcctgctcaggtgcaaacttggtcactggttcctttgtgtattttccccaataaactactggttatcaacatatctctgactccactttgtaatcatcaataccctgatgttgggacccagcccccacagggtctttaagagttgttttccagcataaccacaggtacctcctattttcctgacctcatcccactaggatcaatatcctgttgtgaaccctttgacctggggtttttgtaagtttgtatatagggctgctccacaataaaggtgagagatattctctcagaaaataaccagttgtcttgtggttcatccaaatctccaggctttcacctaatacttggacttagtggtggccaagggcagccacaccctgccagattactgaaggtgtttatcagctgtaggagttccctggtagaatttttgggatcacttatgaatactataatatcatctgcaaatagtaaaagtttgacttcttcttttccaatttgtattcccttgatctccttttgttgtcttattgctctagctagaactttgagaaccatattaaatagatatggagagagtgaacagccttgtcctgttcctgattttattggtattgctttgagtttttcttcatttaagttgatgttgtcagcctattttctttcagaacccaggaccctaccccatcaatcactaattaagaaaatgccctgcatatttgcctacagatggatcttatggagacctgtagcatgaataataaaaacccagagacagatattgggtttcaagttgaagatcagaaaagcaaagcagccaaaccagcagagagctcttacctctaccaaggctggggcaatcctgacctcaaagtgcccaagactgaatactgaatgccctgctcctatcttacatacctctctagtgctggtattaaaggcatgaactctgtttctattttagactgattcactctcatgtagtcccaggtgcccttcaactcacagagattcatctgcctctgtctcccgagttctgagattaaaggtatgtgccatcactgcccacatctatggctgtggctagctttgcattcagatcttcagtggctttaacagatcataagcaatatatcaccacagagaccttttcttaattgaggatccctcctctcaaataactagcttgcaacaagttgacataaaactatccagcacacttaccaactaggaggcaacaagatggctcaacaaataaagtcacttgtcaccaagcttgacaaacctacatgtatgacctatactgtggaaggagaaaaccaactcctgtaagttgttctctgacctcctcctctccctctccctctccctctccctctccctctccctctctctcttctctctctctctctctctctctctctctctctctctgatacacacacacacacatacacacacacacacatacacaagataaataaacacacaaaaaaatttaaggattagagagaacaagtaatggtaaagagtatgtggcagccgggcagtggtggcacacgcctttaatcccagcgctcaggaggcagaggcaggcaggtctatgagtttgaggccaatctcactagggttttgaggttccatgttaaactcagagtctgtgtgtgtgtgtgtgtgtgtgtgtgtatgtgtctgtctgtctgtctgtctgtctgtctctctgtctctgtctctccctctctgcctatggatcagaatgtagttctcagccaccactccagtatctgcccgaatgctgtcatactccctgccatgacaatggactaactgtgacactgtaagcaagccccccaattaaatgctttctcttattacagttgccttgttcatgctgctcttgcagagaacctaagttcagtgccaagcacccacgtcaggaagctcacaaccacctgtaacttcatttttgggatccaacaccactcttccagactccacaggaacctgaacacacccatatatactcaaacacagacacacacatgcacataaaagtaaaaagaaatcttttttaaaaaatattaagcaacaagccatctgaaattctgaataggaccctagtctgtgttactgtgctgtctgtccaagtttcacatttgtgctgtgtgtttgttaagcatgtctttctgtccctactgcccacgcacttggtatgcatgggtcaggggtcttttcttgctgccctgagcacgtggcatggttcaggagttcctctgcccatgtgccatgggttagaatgtgctgcagcggagtcccctgaggctgctactctgaactccaaccattgctggggccctcacagctgagcctggccaatataggtgagtcttgtttttctatcctcacctgctggtctgtgaggcatgggaagtggggctgtctctgccccaaatgccatcctgctgtgggtcctggcttgtggcgggagtttccctgccctaagcatatggttgcaaggccaccatctgcctggctgcccggccttctctatgctccacacacatggcatgcagggagaccacaagggtctttttcccacccctgtattggcaaagggtctgggattaccagcacacacatccccaggtctctgccctgagcacatggagctggggcagatgaactatctggcctgatcgggaccttctaaagaaatggccttaaagatattaaaaactataaaagggactttgataagagtttttatgttgactgagaaatagagagaatgtaggagactaaagtaataaagagggaaagggaaagagaaatttgtctaagaatgtctaaaagatcagaggaataaaccaaaggtatatagaaagttatagagggttaaagcaagccatagaaggtcagaggaaaattgtcgaaggtcagagaaaaggttgttaaaagtcagagaacaatgtaaactgtttgctatggtttctcatgtctacaaattttaaaaattggtaaaataagttaaaattttaaccatactaagttaattctgatttaaaagttctgtttatttctcaagtaaattatgtatgcttgttttaaaatgttctgtttcctggcataacctaagttctgttacaagcatacagctaaaacaaatggtgcaagtcacctccattttatagccagtcacacggcaaactggtcacatggctgactggtagccattttgctaaggttgaaaaaaaagatacttaaaccgacatcttgactaaagatgactgcatggaaattagaggtaccatcttagaaacaagttttcaattaagatttaaaatgttaatgcttctatatattacagaaagacattaagggattttaaatttctttttaaaaccagttttctaaatgtttatgcttttttaaaatgtttttattaatgtttttacttaaagagcttcaatttagaatcatttttaagcaaagcctgacaatgaaggttcttgttttataaaagctgctaatctattataagatgttacagtttatgttttcagaagttaagtttagggcgtttgtggcgcatacctttaatcccagcacttgggaggcagaggcgggtggatctttgagttcaaggccagcctggtcgacagagcaagttccaggacagcctccaaagccacagaaaaaccctttctcagaaagaagttaagtttaagcacgcagctaaaatgtgtacatgtagctactgtttaaggaatataaggtaactctatgcagtcttaaatttagctgtgctaagtttcaaatatttttctaagttaaaaccagttacagtcaggctgaaaattaattacagaaataagaccttacccagccacctgtatgcttcttgtatgcttaaggcaagtaaccaaacagacctctaatgcttcagagatctgcagaatatgggatttaaattgttatctttaaagtctccaaagaagattatgaggcacctcagttcctgcacctggaccagtgagcctgccagccgcctgccagaacctggtctgtggacaaagctgctggacactggaaaattgattgcaccccctttgcctaggcaaaacaaggtcagtcttttccatgtccctcttctacagtgagaaaaaaaaatcctctcaccttataggcctggtgaagattgctgttctttgagacatctgcctccagctgtaatggagaaacttgggtatagctaactgtatatgaactggcttctgtcacttttttgtagattcagataaaatatacccttctaagatctctgaaatattaatggttgtcagcttgacagcatcagacagtcaggttcactataggctatagtcagtatgttagctgataaagtagtgactacctatttgttcaggcacaagctcaaggtttttaggtttactttggttgttatctaagcataaacttaaagggcttttcatcaggccaaaggcacctctgttcttaaacaggtttctgcttctggcagacacatctgagtatatcagttgctgacaacaggctgttcctaaatagactgcgaaccctagacttgctgtggatgtgaaccagtccagctgatgtggacaccccctgtctctgcaacagagtctgccaacagcttctgatggattccccattgcctaaattccctcttttgcttttgactagcatttcagccttcttaggtccctaacttcatcccaaagtcagcaggaaatagcatgggaaagaatacgtcgcccattttccctggttgaaatgctaagtcagaagaaactcccttgcatggggatgccaatatctctcactccctgatggggactcgagagagacagcaattccatgattggaatttcaaaaaaaaaaaaaaaaaaaaaggggggaaaggagggcccccccccccctttccgccagccataacagccgaacacgtgcttgtctgactttgtcttagtcactaggaggttagatgcctgcctcgtggcaaggagacaatcagaagttagctggtggtgctatgctttatcattctgggtgtgctttaccgacaagtgcacagcaatgactcgaagagcatagcaaccaccctgggagggcctatgggccataacaaccagttgaccaatcaacacagggcaaaccctccaagcctggaggcacaccaatcctgagcctgtgcatacccctagacactccctttatgctgccctatcagatctctatgcagacacttcgagctgtctttctagccatctgccatggtgggtggatgaaagaaccgagctaacatggggttagctcgttaaacaactataataaagcctcgtgctgtttgcatcaaaaaaaaatattaagcaacagattcactaaatgaattttaactatgaaatgaaatacagaattaaaaatttccttagatataaacatacataaagtcaaagccttaagtaaaaaaagagtaagcaagcaagtctcccaaacaactattcactgattcctgaaattgagctgtggaagcaaaatgcattccacttacacagtagttaattcccaaggggcagggaatcatcttctaaattgcaggggcttaaaaggtagaaaagaatgccattatatccacacttaggcaattgtagagtatttaaatgatggatgaaaaacaattgtgggatactgactagtcaaaaaaacgaagcaactaacactcctacataaaagctgtcaatagtttcctgagctagagatatcattgggccatctttgagttattcagagttgtctgtagaagaatcatttaaaggttcacatttgtgttataaatttagggtgaagacttctgttgttgtttccttataaaactgtaccctttatctttttggcacaaaagatacaaagtctctttggtatctgggatataaatcaggggcaagagtgatggaaggcagagagagccggtccagcaacacatgcaaccaagagtagacaccactttggatctggcatcccttggggagtatgattgctatggaacaatcttttctacaccatgaatatgtattactttcattggttaataaaaagcagaaggctggtagctgggtaggaagttaggcaagaaagtcaaattgagaatgctgggaaggagaagggcagagtcaggaatccccaatcagatgcagagggagcaggagatgaactcaccatgctaaataaggtaccaccacgtggcagagcataaataaagaatatgggttaacttaaaatgtaagagctagttagtaataagcctgaactatcagccaaacatttagaagtaacattatgtctccaagtcaattatttggaaagcagctgccaggtatttgggaataggcagtccaagagaaatgtccaattacatacgattttcatctgggtcttcttgtcattttccttctggtaacttttgttatgcttggaaaatttacttttaaagaattgggaaaagatccataacagatgttctcttcaggataagatggacactaacgaggctggagagatggctcagtggttaagagcactgactgttcttccagaggacctggcttcaattcccagcacttacatggcagctaagccaagatctgacaccctcatacagacatatatgcaggcaaaacaccaatgcacataaaaaaatgtaaataaataaataaataaaagttggacactgaaaatagaatcaactgttcaggactgaaccatactgaagaaggctcccctgggctggcatgctagtcagcagagtgtctgaagcagatcacggccagacacaattaacagttcagcatgtccaaatacacagtctgtttcagaagcaagtatttcaaggactatttctattggtaagagcttacagtggacctgttgatatagctcagttagtgggaagtacttgttcagcatgcatgaagctctagatttgatccccagatatgcatacctggtgtggtggttcatgactttaattctagcattcaggaagagggggcagcaaattcaaggcctgccccaattacaaaagaacctacctcaggggaagaggtgagtgggagcattacaagaattatttttctttttccccatgtggtgctagggatctaatctagggccttgcttactcttaacaagcattataccactgagttatacccacaatcctcatataattgctaaaggagtaaagatttgaactgaaatctagttctaattattccatgctatcatcatggattttgatttttgtgctttttgtttttacttcatgaaaataagtgcaatgggaccattcattgctcagagcctattaatagggaaaagctgaaaaaagatggccatgatgaaaatactcaggccaaaataaataagtaaatgaacaagtagatgtggttagcatttaataacaaacactgtgctgagaagcacttaacatagagacagaaaagaaacccataaataagccaagataaaaatgaaacgtagagacaaaggagccattaatttatgaaatttattgttgtaaaaagctgttcaagtgacaacaaagaaatgtgctcttccatttggtacaaaggtgcttcatgatcactgccttgtctccaaagcataaggaaaaactggccaagtccactgttaagccatccactcaggtcaagcaatgcattgatgagtctttcaaagtggtcctgcagagaatgtgtcctttgagagtttgagaactggcagaggtgatctgaaagaaaacccagcaaaagacaatgtaacctgacagtaccatggatgcaggacatggatagagatgacaggaagttcatggtacttatgttacctcaaacctgaaaggaagacacatcagacagaacggcaatgtatatgaggtaagaagccacacactccatcaggtgtgtgaggtctgtgagggactatgaacattacaaccacagtaattaatcggtgaatggggcacacgctgaatacctgattggaatacagacttccttacccacaacagagtttcagaggaagacaggtaataaaaatgatttcaggcactaaaaattactctaaagattgtgggggacaagtggttaataggcatgggaattaggcaggaaaagttgcttctaaacaatgatgttcagaggtgagcacggagaggtagcctcaaaattaaaagaaagaaaccagggaaagagcaagaatctcccaagccaaaacagcatgtataagttcctgagaacagaatataagcaacaaaaaggtcaacagagaatgagtgaagaccatcaagttggaaagtaaccggtacagatcacataggcctgaatcactctctggctccagtgaaaagccaatggagggcccaagcttcagggtaaatgatttgaatcagaaagatcacaccagctgtcatggggcagaccctagaggagaacaagaacagaagcagagaaggtgaaatttctagaattctctagccctgctaagaggggtataaaagcacctgggctattcccatgagcagagccacactatgaccagcaatacccagtcacatacccaacagagatgtgccttacggcacacgcacatggaaacacatagcactatcacatgtacgagctcctacctggaaacaaccaatatggcccatcagcaataaacacacaacaaactgttgtgataggaaaacacactcacagaacaaccacggggtataagttgaggaaaaggaggcagaaattcaagctacatactatagaattcagtttacaagaaatcaaaaccagacaaaaccaaactatagtacaaaagtgggacagggtatggcacaagcctacagttccagcactcagatggctggggagtaactaggaagcacatgaagagcatttctgggtcccaaaagccattctttttgatctcagaaatagttacctgagtgaggtcactgtaagaattcactgggcagggctgtggtggtgcacacctttaatcttagcactcaggaagcagagggtggctgatctctgtgaatttgaggccagcctggtctacacagagagttccagggcagccagggctacacagagaaatcctgtctccaaaagagagacagacacagagacagagacagagacagagacagagacagagacagagacagagacagggacagtgtttcattctgtgaaatagcccaggctggcctggaactcactatgtccagactagccttgaatttgtggctatttgtagcaggctttcttgaactgccagtccccaaatcatgacacggagacgtattaatcatgaatgctcagccttagcttaggcttgtttctctatgttttgttgttgtttttttttttttaacttaaattaacccatttcttttcatctatgtgctgccccaaggttcgtttacctcatctacacactgtccatcctgctttcctgctttcctgcttcctgtgcacatggctggccccctgctggctggttgggtccccttttctctccgccccccagccccaacgatcccgcttctgcctagatattggctgttctctttttatttgaccaatcaggtgccttcggcaggcaaggttaaatagcaacacatctttacataactaaacaaatgcagcataaacaaatgtaacatatctttttttgttgtttctttgttttgctggttgttttttttttctttttctttggttggttgtttggtttttcttttttttctacattgttttattattattacttacattccaatcccactttctcctcccatctgctcctcggagagggtgaggcctcccctaggaagtctactaagtctgtcccatcatttccttgaggcaggaacaaggtcctcctcccctccccccagctcctcactctaccccatccccatgcctagattccacaaagtcagtttgtgcattagagttagatcttggacccactgccggtggcctcatatattattgccccagccacaccactgtcacctgtattcagggagtgcagttcagtcttatgcaggtcctcgggttgtcagacctgagtcagtaatctctcactagcccgggtcagctgattctgtgggtttccccaccatggtcttgactcctttgttcagattatcactcctccctcaccttgattgtactccaggagcttagcccaaaagttagttgtggatttctgcatctgcttccatctgtttctggaagagggttctagcttctctggggttgtggattgtaggctgggtatcttttgctttatgtctggtattgacttatgagtgagttaatactatatttgtctttctgggtctggattacctcactcaggatggcttttttctagttccgtccatttgcctgcaaattttaggatgtcattgtttcttactgctgagtagtacttcattgtgtaaatgtatcacattttttttacccattcttctgttgaggggcatcaaggttgttcccaagttctagctatcatgaataatgttgctatgaacatagttgagcaaatgtccttgtggtgtgaatgtgtctcctttgggtacatgcccaaaagcggtattgcagggtcttgaggtagatcaattgctaattttcttagaaatcaccatactgatttccacagaggctgtacaagttcaaactcccagcagcaatagaggagtgttccccttactccacatcctctccagcataagctgtcatcagtgtttttgatcttaactattatgatcagtataagatatcttagagtgttttgatttgcatttccatatgactaaggatgttgagcatttccttaagtgtctttccaccatttgagattgttctgttgagaattctctgtttagatttgtaccccatttttaattggattatgtggtagtttgatgtccagtttcttgaattctttgtatattttggagatcaaccctctgtcagatgtgaagttggtgaagaccttttcctattctgtagagagtcattttgtcttttgctttagagaagcttctcagtttcattagttctcaattattaattgttgataccagtgtctgtgctattggtgttagttacatttaggaagtggtctcctgtgcctatgcattcaagggtatttcccactttctcttctatgaggttcagtgtggatggatttatattgaggtttttgatccaattgggcttaagttttgtgcatggcgatagttatggatctattttcagtcttctacatgtcaacttccagttatactacaaccatctgtcaaaaatgtgttcctttttccattttatatttttagcttcttataaggtgttcataggagtgtgggttgatatcagggtattcgattccattggtccacctgtctatttttgtgccaataccaagctgttttcatttctgtatctctatattagagcttgaagtcagggatggtgatgcccccaggtgatcctttattatacagggttgttttggctatcctggggttttttgtttgtttgtttttccatatcaagttgagtattattctttccagttctgtgaagaattgtgctgggattttgagggagattgcattgaaactgtagattacttttggtaggattaccatttttactatgttgatcctacctatccatgagcatggaagatctttccatttttttgatatcttctttagagacttaaagttcttctcatacaggtctttcacttgtttggctagagttaccccaagatacgttatgttatttgtggctattgtaaagatggatatttctctgatttctttctcaccctgtttatcatttatatataggagggctactgattttttttttttagttaatcttgtatcctgctacattactgtaggtgtttatcagttgtaggagtcccctggtagaattttgggggtctcttatgtaaactaccatatcatcagcaaatagtgaaggtttgacttcttttccaatttgtatccccttgatctccttttgtggtcttattgctctggctagaacttctagtaccatattaaatagatttagacagagtggacagccttgtcttgttactgatttcagtgggatcattttgagtttctcttcattaagtttgatgttggctgttgggttactgtatattgcctttatcatgaagggtgttgaattttgtcaaaggctttttcagcatctaatgagacgaccatgtcgtgtttttctttcagtttgtttatatggtggattacattgacagattttcatatgttgaatcactgggatgaatcctacttggtaatagtgaatgatttttctgatgtgttcttggattcagtttgccagtattttattgagtatttttgcatcaatgttcatgagggtaattggtctgtaatcctcttagttgtgtctttgtgtgatttaggtatcagggtaactgtagccttgtaaaaagtttggcaatgttccttttgtttttattgtgtggaataatttcaggagtaatggtattagctcttctttgaatttctggtagaattctgcactgaaactatctagccctgggctttttttggttgggagactattgataactgtttgtacttccttaggggttacagttctttatctgttcttgatttcattttggtatgtggtacttatctagaaaattgtccatctccttaaagtcttccaattttgtggagtacaggtttttaaactatgtcctgatgattctctgtatttccttagtgtatgttgttatgtccgcctttttgtttctgattttgttaatttggatattctctgtgtcttgattaatttggataaaggtttgtctattttgctgaatttctcaaagaaccaattctttgtctcattgattctttgtattgttttctttgtttctattttattgatctcagccttcaatttgactatttcttgctgtctactccttctgggtgactctgcttttcttctagcactttcaggtgttctgttaattcactagtgtgggatttttccagcttctttatgtaggcatttagtgctatgaacttttctcttagcactactttcattgtgtcccataaatcgggcaatgttatggggtcattttcattaaattttaagaagtctttaatttctttccttatttcttccttgacccagtggtgaatcagctgatcactgttaaatttctatgtgtttttaggctttatgcaatttgttgttgaattctaactttaagccatgatgatccgattagatacctggagttattccaatttttttctatctgttgaggtttgttttgttactgagtatgttgtctactgttatagtatgttttgagaaggttccatgcagtgttaagaagaaagtatattcttttgtctttgggtggaatgttctatagatgtctgttaagtccatttgagtcataacatattagttcccttatttctctgttaagcttctgtctggcagacctgtccagtggtgacagtgggatgctgaagtctcccactattagtgtggggggcttaattcatgatttaagctttagtaatgtttcttttacaaatgcggagaccttgtgtttggggcatagatattaagaattgagacttccttttgatgggtttttccaatgatgaatatgatgcccttcttcatcttttttgattgattttagttagaagtctattttgttagatattaggacagcttgtttcttaggtccctctgattggaaaatttttctcaatcctaactgaggtaatgtttgtctaaggttgaggtgtgtttcttgtatgcagcaggaggatggattctgtttttgtatccaatttattagcttgtgtctttttataggtgatttgagaccattcatattaatggatattaatgaccagtgattgctagttgctgttatttttgtttttgttggtggtgatggcattgtgtgttcaattcccttctttcagatttgctgctacaagctcatctattgcctgtgttcttgtgaatgtagctgacttccttggcattttccttctagtactttctatagggctgagtttgtggacaggtattgtttaaatctggctttatcatgaaatattttgttttctccatttatgattattgaaagctttgctgggtatagtagtctgggctggcatccgtggtcccttagtgtctgcataatgtgtgtccaggaccttctggctttcattgtttctattgagaagtcaggtgtaagtctgcctttatatgttacctggaccttttattttgcagttcttaatattctttctttattctgtatgcttattgttttgattattatgtggtgagggaacttttttattggtccagtctacttggtgttctgtaagattcttgtactttcataggcatgtccttctctaggttgggaaagttttcttctatgactttgttgaatatattttctatgtctttgagttggactttttcttctatccctattattcttaggttcagtcttttcttagtgtcccagatttcctgcatgttttgtgttaaggatttgttggatttaacattttctttgaccaattagtctatttccaatattgtatcttcaatgcctgaaattctctcttccatctcttgtattctattgtttatatttgcatttgtggttcctgattgtttacccagattttccatttccagagttcccttggtttgtgttttcttcattgactctatttcagatttcaaatcttgaatcgtttccttcacatgtttgaatgctttttcttggttttctttaagggatttttcgttatctcccaattgtttgtcttttcctccatttctttaagggactttttcttttcctctttaagggcctcaatcatcctcaaaaagttatgtttaaggtcgttgtcttctgcttcatctccattgggatgttcaggccttgctgttgtagcaccactagtttctagtggtgccatattgctctttatgttgttgagtgtgttcttaccttgtttctatgcctctcttcttccaatcggtataggaggagcttgtgcttcagggggtctctctttctccaaatggtatagttgggagctgtggttccgttgaccactccttcatgtacaatcagaacagagcctccagtgatcactcttcctggtggaagtgggcccaaggctcaggcagtcgctcctcaaggtgcaggtgggcctacagctacagtaggaagaaggaccaccgctccagtgattgctcctctatgtgaggtggtgctgaggttccagtggtcactataacagtggggtatcttgaaccaagaaatggcaatggatgctggctgggacacaggtgcactttcccacaggaacttcttgtgatagcttctggaagccactgttggaagttgctgctgtcatttcctccagcagtcactccctgctcctgggccagtggctcaggcctccctctaaggctgctcctgggcctgacgctcaggcttccctcaaacatatctttacatagttaaatattctattccacaattgctatcctcccgccttactaatctggctaccttttagcttttagttaagccattctcaattgtgtgcagtttagctctgtgttttttgaggtattcatttcaaccttgtttctactaagaataatattttttttcttttggtggggaaggaaggaagacacagtccctctatgaatctttagctggcttgcctaaaacaggagcttgtggactgcctggaataggtgctggaaagggaacttggatcctctagaagaggaagaagtgctcttaattgataatccatctctccaggtgctctatatgtttttatattaaactaagagagagtgttgccataagtaacccaaaattcctttcaatttatagaatttaaatctttaacaaaccagttaattcaaatctgtaggtaaaccagacttggtgatgcacaccttttatcccaatgctcagaaagaaatgctctcttgagttccaggtaggcctagtctccatagtgagtttcaggccagtcacagatacatagaccctgcctcaaaagagaattatattatcatagcatgggaaccttgataagatatgaacttttatttttggtttgaggacaaattttttacttttatttatctattcattgtgaacaactgcacaagtaatatggatatatgcactttgtgcatgaatatgtggaggccagagatcaaccttggtgtcattgcacaagagctactcacctggtttttgagacagtgtcacactgggacttgggcttatcaactagggtggcccagctggacagtaaaccatagagatcctatctcctccccagtgttgtgattaaagtcttgtaccagaagctaggtgaagtgacacagcctttaatcccagcactcagaaatctgagatatccatatctctctctgtaaattcaaggtcagcttggtctacatagtgaattccaggccagggcaacaaagtgaaaactctgtctcagaaaacaaaaataacaacaaagttgtctgccaggccagaacttgcctttaacctcagctcttggaatggggggaatgggggtcacagagacaggcagatttctgtgaattaaaggacagccttatctacatagtgagttccaggacagttagagctacatagagaaaacgtgtatcaaaagataaataaatagctgagcagtgacagtgcatgcctttaatatcaacactccagaggtagagggagagacaggcagatctctgtgttctaggccggccgggtctacagagctagttccagtacatccagggctacacagaaaaaccctgtcttcaggagaaaaaaattacaacctgatcaccaacctaattgctttttatcaagtgatccatagttaattacaatgaaaaaaagataagaggcaaaattaaaaggcaactgttagagctcaggcaatccaaatatccagaaatgagctcaaactgaattataagaggatttccagcagttagataaaagcatgttttccttgacaacttgtgaaactagttcccatctgtcaaaaggagtaatttcccttacctctggcagagggacaaatggctacctgtggtttcatatcaaagcccatgctgcctccaggctcactcaatccctactcacaagtattagtaatatgtttcaaagtccacactggcctttctcatctcagatccctgctctctttgtgtcccctgcccctgtctacgcttgctatcctcactatcccctttctggctagtctcttttctctcacaggtaaccctggctatgtccagtcagtttgtttaactcactgctctggactcttccagatgcctctttctctctcttattcacaataaaatccttccctaataacggagcggtcatgtcagtaatttctttactgcaccaccttgcatatagcaactaaatccaaagttacactgctatcttaaaaaataatcttgggcactctcggaaaataagagcacatactgtgggggttggagagatggctcagcagacaagagcaatggctgctcttccagaggaccaggtttcaattcccaggacccacatggcagctcacattgtctgtaactccagtcccaggagggatccaaagccctcttctgtcctccacaggctccaggcacacacatggtgactagctacacatgcaagcaaaacatctatacacataaagtaaatgaatgaatttagaagaaagaagggggtgcatattgctcttcctgaggatttgaattagttcctagcacccacattaggtggctcacaatcacttctaactcgagctccagggagatctgaaacttctgacctctgcaagtacctgcattcccgtgcacagacatacacatacacacgactaaaaatagtaaaacagacatacacatacacacgactaaaaataggaaaatagggtctcagaggtggcttagtggtgaagagaaagtgctgatcttccagagggcctaagtttagttcccagcacccacactgggaattcccaactttaagaagagcatttcttggtccaatgtcaggaaagggaaggggcctccagctagtaaactggttgtgttctgaggttttgtcagatagtaaactggttgtgttctgaggttttgtcagacagacagaacaaggaaactcaaaaccccttaccttcaccagcacatagtccccaggctgagctctgaccttgagcccagagttagtgacatcctccacctctgcatcagggaagatcaccttaaggtttgcatcattccggccacacaggtctgtggaagaacgtttgctgaactgcagaaaacagagagaatatatgcatctgtcaggagttctagaagttttaggaggcagacactgctcctgttgtctgaggctctcctgggtctatcacaaagcatttcttttctttcttttttctttttaattaatttatttacgtatccctacaaggccagaagagggtaccaggtctctttacagatggtttgagccaccatgtggttgctgggaattgaactcaggacctttggaagagcaggcagtgctcttaacggctgagccacctatccagccccacagaacatttctttcttttttttttttttttttttttttttttttttttttttctttttttttttaattacaaacaagattgaattacctgacaatcccagttcccttctccctcccttcctcccctaccatccccccaactaaaaccctccctatcacttcccttttcttctaatctacaactgactcaacctttctgctccctcatgacctctgcattctttcttttcttcccttctcattctcgtagctccctcccccctcttcccatgttctcaatttgaacagagcatttcttaatgaggaaatctgaagtctcactttgtgtggctgattcaacaataggacaacatgtggtgcacaacagaaacaaagttctgttgactattttaatgaatcaatgaatctttacagggatacttagagaaacactctcttgaaaaaaaaaaagaaagaaagaaagaaaattcaaaacaccaacaagaaaataaaccagcaaggtcataaaatgaaaaaagtaagacattttgggcttgagattgattgtacagtgtttgtctagcacgcaggaggccctgggtttgatacaacaccacataaccggggcatgagggtgcactcctgtaatcccagtgcttaggaagatatatgcaggaggatcagaaattcaaggtcacccttagctacatagcaattttaagatcaacctaggtaaactacatgagaccaggtctcaaaaaagtaagaccgacataaaagagacacatagtgttattctaaaaggcaaaaaccatgcgtgtgaacttaccccttcaaccaatactagctgggtacaacccactgaggtctggttggctcttgacgcctcttctctgaagatagtaataagttcctccaaacgccttaatttgacttcttctggaacatcgtccttcagcctatgatatgcccgtgtcttctattaaaaaataaaacagaacccaggtcactaaggagttagagaatcctcagggcacaaaggagggaatatattcattctactcacaagttacagacatgtaatttggtccaaaacccaaacctgaaccacatttatttctctagttctgggaacattccatgagaaaagggcaactaaaatagatctttgtagattcattctaaatttagcaaatgaaaatcacactcatggctggcaggatgggtcagtgggcaaaggtgcctgacaccaagactgatgacctgaatccaatcctagccccatacagtggaatgaaagaaccaactccagcaagtggccctctgacctacacacactacaacacatgcacacccctacaaacaggcatacacaaaatcaataagtatacaaataaatacatttaaaaaatcacagactcaggccaggtgctggtggcactcgcctttaatcccagagtcaggcagatctctgtcaattcaatgccagtctggtctacagaatgagttccaggacaggctccacaacaatacaaagaaaccctgtctcaaaaaaccattaaaaaaaagaaaagaaaagaaaatcacagactcaaagttagtcttcatactagtcctaagtttatatttggacacagactaaataatgcatacactaagctactcaccagcgctgtttatagagacacagatataaagcagcctgaatactcactaactagtacctaataaattatggtctatcaacacaatggagtgttaagcaactgttaataagataacaccacaaatactaatgtaattgttccaaaatactccaaaatctgaaattagtaaaatctaatcaacatgcatgtcgttggtgtagaaagcattcatgtttatgaacacataacatgtatctggaaactgataaaagaaagaaatcactaagagtggggctggcgagatggctcagaggttaagagcactggctgctcttccagaggtcctgagttcaattcccagcaaccacatggtggctcacaaccatctgtaataggatctggtgccctcttctggtgtgcagatatacatggaaacacagtgttgtatatatactaaataaataaaatctttaaaaaaaaaaaaagagaaatcactaagagtaattgccttcaaaaagagaactaagcctgggagcaacaaaaggaagaagtgttttaaccttcacacttcattccataagcacctattacctagtcagaaacaataattatccttgaaaagtgtttaaaaactatcctgggtatacacttatatatgtctttattctcatgctcaaatcaagtggagaacaccactgagctaggaaaaagtcaaggaataaaaggaaaagctaaacaccactgtctggagattcaaaccaatctaccctgaaagaactaccatatccacagaggaaaacagaatggggactgggtataagatcctactcgatgtcagcatgttgtaagtaatgataaccatccgatggcactgtaggaagcaccactctaagtgggttacatgcactatcttattcaagcctcaaaacacgcctaagctggtactgctattcccacttcaggaagcaactaaggactttagacaaggtcactgttactacatgacaaaggcacattttgagtgccatacttccattgtgtgttgacaggccacttcccgagtagaccagtcttataaataatttctcttgtgcatctgtgatgtccaggctctggggaagtctcacttctgaaatactgtaaaagatactggcccacttacactgactacagaacactgagcactggacttcaattttgtcttgatttacttatttatttgtttgttttgtttttaagacagtctcaatctatagtccagacctgtttcaaacttaagattcccctgcctcaacctcctaagttctaggattacagccatatatcaccaaacccagctacctgcaaaatagttcataaataggaacactagcttggtaatttttttaagttttatttatttattatttatacagtattctgtctacatgtatgcctgcaggccagaagagggcaccagatctcattatagatggttgtgagccatcatgtggttggtgggcattgaactcggcacctctgaaagaccagccagtattcttaaccactgagcaatctctccagccccaatctttttgggttttatgtgttttttgttttttcgagacagggtttctctgtgtatcccttggctgtcctggaactcactccatagaccaggctggcctcgaactcacatagattggcctgtctctgcctcttgagcactgggatcaaaggaatgcaccaccaccacagcccagcccagcatggtaattttttcatatcaatttgctgaggtttgttggctgtagtgtctaacacccataatgctaatgatcaggcagccaagtgaagcagaaggaaaacaggcttgagtccagccagagcaaaaattaactagagaattaattagagaaattaaaattaaattagagaaattaaaattaattagagaaaatgacggtaagatgctgtgatatagctgggtgtggtggcacacacctttaattccagcaaacaagagcagaaccaggtagatctctgagttcaaggccagcctggttctgagactctgtctcaaaacaaacaaaaaatcctgggattttacaaagtcaaactctttccacccaaccacctccaatgagtcccaagctggtaagaaaacgatgctaattgtctcccattcaggacttacctgcctcatgctgtatgcaaagagaaaaccggcattatactgaacttctcgaagtaaagacactgtctgcaggtgatcatcctctgtctctccacagaagccagtgatgaagtcgctgctgaggctcacacctgtcaatattcaacaaaggaccagtgcttagagactgctactgccgacctcagaaggaatgtgggcatttacgtattacagaaggaaggaaagctgctcagaagtcattacagagcaaggggaaagaggcttgtttttctacaacatgacagaactggctcctccctctacatttccttaagccctagaaaataaatcttggtttcaaatgctagattcagagacactatagacgagcagtttcaaacagccctgcttctgcatggggagggtgagggacagtgctaaagactaaacccagagccttgtatatatgctagacaagcactgttgtgctaacactaacactccagctcccaagtcctacttttactagtcaatctttcggtgcttcacataaacatatacatctatgtatcttgttttgttgctattgttttgataggggatttttttttcctactgtgctagggacagaacccattcaacctctaaactagaccgtatctatgtattttaatttataataactgtgtatatgtatatatgatcaaacactgaatttaaattagcattatgttcatttacaatgcagtagcaaaactatcagatactgaatacttggaaattgctatatggccgggcagtggtggcacatgccttaaatcccattacttgggaggcaaagacagatggagctctgtgagtttgaggccagtctggtctacagagcaagttccaggacagctaggactgttaaacagagaaaccctgtctcaaaatatcaaaaaaaaaaaaaaaagtgctacatgtcattagctattcaattactccccaaaattaaatgacatgactactatttactccattttataaattacaaatcttctttgttgtcatatatccaataatacagtactcaatacaaagccagtatacccagctgccatagcatcctgccccatcagaacaaaagtatgtgtacagctgggtggtggtggcatatgcctttagtcccagcactggggaggcagaggcaggtggatctctgtgagttcgagaccagcctggtctacaagaggtagttccaggacagcctccaaagccacagagaaaccctgtctcgaaaaaccaaaaaaacaaacaaacaaacaaaaacaacccacaaaagtatgtgtacataatacaagaagcacggtggcacatatctttagtctcagcactcaggagacagaggcaagtgggtctttgtgagttcaaggccaacctagtctagtaagctctgggctcaaaaaggaaaaaataaataaataaaagttgagggaaatttctgacattctcaatcaaatataagcaaaatgaagcaaaaacagtaatcttattaggagaaagggggaaaaggtataatgggatgtctaaaatctgcctaattaaagtagaatacgtgatagtgcgtgtttataatcccagcaataacaatgaaagtagaagaccaagttcaaggccaccctgagcaacataacaagacactgtgtcaaaattcaagcgctagagctactcttcagtggcagagcatatgtccacaagacatgaggcttggatttaatctcttgcaatatgcacacagtcagaaagatggaaaggaaaagtggaacagagagaggaaaacagagaagcagcaaatgaacataaaaataccaaaaactatgaaatgacaccataaggaatttgccaaagaggctggaaattgagcaagatgaatttggactgcggtaatgtgctcagcatttcttaatgtacctgggatacattctctgatatgatgaaccaatgccacataagcttcccttgaatatctgcagtaaagaacaaaaagaaaagacctagttgagaggagaagcaaggttacgataagttctcatgaagctgaagttagccttaaacttctgttccacctagctctatctcccaagtgctgggctcttagggctacaccaccacacctgactcaatcttatttaaatgagtactatagaaagataatactatgaattcccacgtatattcatttttcgatttgtgatttcacaaccacaaatcacagtagaagagtacatgaaagcacccctttgagccagtgagatgtttcagcaagtagatactttctaccaaacctgatgacttcagttcaatccctggaacctacatggtagaagaagaaaaccaactcctgacaattgtcctctgatttacatgcacacatgttccagctcctaaggacctttcatttaataaatcaagaaaaaaagtaaacacttaagaggacctctaggggctggagagatagctcgatggttaagagaactagctgccgctgcagagggcccaggttcagttcctagcgtccacatggcagctcacaatcatctgccactcccattgcaggggatctgatgccctcttctggcctccgtgagaagtgcatgcacatggtgcaggcatacacgcaggcaaaacacacatacacgtaaaaaaagaggatccctagatctttgcctctgtggaaaataaggccaagttctagttctgtgagctttgccttaggtcatattacccccctccagtttcacctctgcaaacttatttccaaagtgagtcaagtgatctacattcatattctaagacctaaaaaactttattattcttgcaaggtaaaaggctaaaatttcaaatatggcacccagcaagcacttaattttaaaaaaatgttaagcaaatgagaggctcaatgcttactctgcttaggggatacacagaagaaagttcagctgtccatagatacattcaaacaacaaccacttattaatttgctactgtgtgtcatatactatactaggtccttagcaacaaatgcagtgtttagtgattcagaaaaactggaatggttaaggatgtcctctccccaagtatgtctgaccctctcctcatggcatccagtacacggttgcttccactctgggctggcagatggatctgcttgcagatgttgtgtctctcatgaatcagctgtagaacctgattaaacaaaacacaatatgggttacctaagtctcaccaaagaatcatgtaaaaaagaatattctatacattctgaaagggtgcagatggaagtttctgtcctgtcaggtcctgcagccctttagtcccaaataaacactcagaggcttatattaattataaacggtttggcctattgcccaggcttcttactaacaaactcttacaacttaaattaacccacaatccttatctatgtttagctgcatggcttggtgcctcatctcattctcatcttgcttcttctgcctctggttctcgactcactctgccttctttttcccagaattctcatagccccgcttatgtctcctgcctggctcctggccaatcagtattttattaaaccgatagaggtgacaaatatttacagtgaacaagaacattatcccatatcaggagggggttgctgttgttttgttttgtttacaggcattctgcctgaccctgcctcctgagtcctggaattaaaggtgtgtaacatagtacttggtagtatactcctctcattgtttctcctcagaggctaattttcaagtaatgaaaaggttgattgggaactgaggataaagctcagttagtgtagtgactgcttggcattcatgaggctctgggttcaatcctcagcagtgcataaaactaggcatgatagtgcacatctgtaatctcagcacttggaggagaggggaagaatcaggagttcaaggccagcctcaactacacagaccaacatggactgagacctgtctcaaaaaataggaagaaagagccaggcagtggtggcacacacctttaaccccagcacttgggaggcagaggtagatggatctctgaattcaaggccagcctggtctacaaagtgaattccaggacatccagaacagtcaggactgttacacagagaaaccatctcaaaaaacaaaagaaaaaaagagacagtcttgctaagttgcccttactggcctgacactcataatccacctatgtcaagctcccaaagctaggactataagcatgtatcactcactgaccaagagctgggatttgaacccacgtgtgcctcaggcttcccactacatcacattgcctcccttgctgttctcactgtatctccaccatgcagctgcccaccttgataaacttctcactacacaagtggccccaagttcccactgaaaaccatcctatcgcctcactgatcttaggggaatttaagttttgccaaaaggccagtaattctgcaaggagacattgcagtgtaacacagaatccccaaagcaggattcaaggtctctgccgtatacttctgggtccaggtaataatatgcttcaggatgctgctaaaagtttgtcacaacactaaatatcagcaacactcacctcatcaggaaaatccttggggtggggagaggtgaaacggatcctcatttcagggtctattcttgaaacctgatccagaagatgggaaaagcgaagccccccttgtttggttttatagttggtagtgaagccacgactgaggttggtaggcactgcattattgaactggatctctgaattgtcccgaaaactattaacattctgaccaagaagtgtcacttcttttagcccctaaaaacaggaaaaacatgttgaaaacaagtttaaccttcttgaacagcttcatctcaaaccactaattaaaaattagctcaatctaccaagagccataaagaaacctgtctttaatctgataatctcacactggagtaccttatctaaagactgaacaacagagtaagaccttaagagtgtacctgcctgtaatcccaactctcaggaagtaaaggcaggtttctgttaccatctcaatccctaaaacagaatatatctatcctaaaggagttttgtactgtaggagaacttaaaatggggaggaggggataactttagtatttaagcaagtaaaaactgagattttacaagctatcagtgatggaactatctgtggatcagacagaggtggaggagacaccacaggctacaaagctagaaaggctatcctcagcctgtccagaacatgctcgtatgaagaaagcttggataacctcacctgctcagagagcttcctcacttcatctagaatggaggcaaccggccgactcctctcccggccacgagtgaaaggaacaatgcagtaactgcacatgttgtcacagccccgcatgatcgacctagggaagaaagtacaagaacacagttaacaggggagcaatgctgtcttagcatgtcccatctctgcagctctcttgggatttttctttggctctggatcctcctgcttctaagctcacactgaactaatgtgaaatccgtaagtgtataatcacagaatatgaaccagactgtaattggtagacatgttggtgaggaagcatagtgttgaggggaaacggtctgactcagcactgtggagtttctaccgttttgataggtatattagatggaattttttatgcagagattgaaaacaaactctatgtctacctatgttataaaagacactctgaggccaggcggtggtggtgcatgcctttaatcccagcacttgggaggcagaggcagatgggtctcagtgagttcaagaccagcctggtctacaaagtgagttccaggacagccaggactgttacacagagaaaccctgtctcaaaaagcaaaaacaaagcaaaacaaaaagatcctgaatttaaaatatagcttgcatttctcatacaatctttttctttgagacagggtcttctgtgggtcagactagacttaaactggtatatagcaaaaaacatggatgaggatcttgaactcctgatgctcctgcctccatttccaagtgttgtgtttacagatatgcatcatcatatctgactctagctttggttttctgacacaaggtctctcaatggagctctaaattgcctagtacatgctgtggagcccagactgcccttgaacgcacagcaagcaatattcctgcctcctgctcccaactgttaggattataagtatgagcctctttcttcccagctgttgttttctatttctgaaacaagggctttccaaataacacagattagcctggagcaacaatcaaccccagagtgaccataaactcacaacaatcctcctgctttggcctcagattgtgagcacacactacagcagtttaaaaaaaaaaaaaaaagttttctatcaagaaagcccaaggcattcccttaagtgaaaataaacttagaacaataatatttatgttttaaaaggagggtaagaaaagtatccatatgagtatatgactacatatacaaggaatacttctagaaagattaaataagaatgactgacatggaaatctttgagaaatggcctgagaaagcagggatgatgggtgtgaggagtcttacggtatcacatgttgttttctgcatgttgtcccataactgttcaaatgcattcctttcccttatgctcaacatagtaaactgaaacatgctcatcctccaggtctcacatgatgactcacacaaaggcagaagtggcactggggcttgtttggactggcatgatatctgcataggtctcatccagagagagaagcacgtttgctgcctgctgacctgactccacaacagccagcagccggggaaggtctcgataggcatccggtccagccaagagatcgactgttttctccctgttgaggatctctcccttcagtctctcagccatgcagcctgggaagcaaaagaaactagtacctcttctgcagttcacctgttttcctggcttttgttcagtgcacataatttataacttgccctggagaccagggtacagaaaacttctctgagtttagtattaccctgcaaaactggacccacacaactgaacccacatcttcaaatacaagaaaaccatagaaatattcagagcaaatcaattaaatgtctggaatgtgcagggaggcatccaaaagcctttcccccattttttccatcactgctggaggtgcaagtcagagcctcccacatactaaccaagcacaccatgagtgagctgcattccctgccccccaaagcctctcaaacatgaaccacctcttctcacagttaaagattacttaccactaagataaaagatatccttacatcagaagtctgtctataagtttacaactacacttaatgcttttttctctttcagcccacaatacttgctaaacccatgagaaattatataaataattatgcagataaaatttgtacccccaaaccatcattttattaagactataaaacctaaaagcataccttttacaaagtctttggaatggttagttgtttggggttttcttaaagattgttttattatttttgtttatgtgaatgtgtgcttgtgtatgtgcacatgactgcaggtgcctgcagttcagtaaagagtgttggatcccctgggtctgcaattacaggcagttgtgaattgcccaacacaaatgctgggaaccaaacgaggatcctctgaaagaacaatatatgctcttaactgctaatacatctctccggccccatagtttggttgtgatggctcagaggttaagagcactgactgctcttccagagttgctgagttcaattcctagcagccacataatggctcacaaccatgagatctggtgccctcttctggcctgcaggcatacacactgacagaacactgtatacataataaataaatcttaaaaataaagagaaaagaagggagggagggaggcagggagggagggaggcagggaggaaggaaggaaggaaggaaggaaggaaggaaggaaggaaggaaggcaccaagtcccaaatcagtcccttacattaaaaaagattttaaaaacaattaggggctggagagatggctcagcagttaagaacactggctgctcttccagaggaccctggttcattcccagcactcacatggcagctcataactatctctaactccagttcaggggatctgacacctttataccaatgcacataaaataaagttaaataatttttttcaatttttttaattattgggtggggtgccgggcgttggtggcgcacacctttaatcccagcactcaggaggcagaggcaggcagatctctgagtttgaggccagtctggtcttcaggaaagccagagctgttacacagagaaaccctgtatcaaaaaaccgagagagggagagagagagagagagagagagagagagagagagagaaaagaaatgatgcacatattctctctcagccttgattgtggacgtcatgtgactagctgcttgacttcctgccttcctgtcttgacttcccctcagtgataaactgtaacctggaattgcaaagtcaaataaaaccttttcttcccttttggtcagggtgcttcatcacagcaacaaaaaaaactaaaatactccctcttgcatctccttcaataaatctcttgtgtgaggtttgctgtacagtgtgactttggggtatttcttagctcccctcagagctggaacacttacagtagtaatggctgcataagcacgtgaatatacttaatactacagaatatatataaaatgattaaaatggtgagttgatgtatacaaccattattttacatttttccatgggggtttctaaaattccaaaagattttatacccaagggcaactataatgaagtgaaaaggaagaaaactcctctagcatctatctatattaatcagtatgactggatacactgtgtgttgactatcaagagtgattaagttaactatactaaaatggacacggtccactaagcataaagttaaatatattaaccaaattggggtcagaaaggatgcatagatttttcttttgattggggtattttttgcatttatttatttatttagcgtgtgtgtgggtgtgcacatgctacagtacccatgtggaggtcaaagtggggtagttggttctctcctcctaccatgtacatccccaaaatcaaaggcagttcaatagacttgatggcaagtgctttccctgctgagccacctggccaaccccccaagcacttatttttgaagtatgtttcctgaccacctagaccagaactgtccaacagagctttcaaacaaggagaagggacgtgctggatggaaatgactggaggtgctgtgtaaattggtggaccctcatcagatgtggctgctgagaagctgagatgtgtctgatgcaaaggaagaagtgcatttttgaaattgtttttcaaatgtgactactgactaccatattggtcaagacaggcctggattttcacttgggcttgcttccgtagttcacatgacaggtaactacactggaaactcgtgttgccctccagactccaaatgctgaaactgtctctccctctctgtactacatgaactgcatcaggctctagggaaaacacatcactatctgagcatctactatttctttatttgtttgtttgtttgggtttttgttttgttttgttttttgaaacagggtttctctctctgtgtaccaactctggttgtcctagaactcactctgtagaccaggctggcctctaactcacagagatctgcctgcctctttctgcctcctgagtgctgggattaaaggcgtgcaccactaccaccctgctaaatgcaagctgttaaatccctcatagcaggaataccattatcctactcttttgaaggtttttgtttgttggttggttgagttttttggtttttggtttttattttggttttggttttggctttttttgagacagggtttctgtgtaacagtcctggctgttcggtcactccgtagaccaagctagcctcgaactcacagaaatccacctgcttctgccttccaagtgctgggattaaaggcatgcaccactgcctgggacatctattatttctaagtgctacaaaaagatcttttagaagcttcatctcatttaatcttgcaatctctaacatcaagtaaaagagattcatggggtagatatggctaatttacaccctgttatccaggcctctaaagcagcaattctcaatctgtggtcacatatcagatatcctgcatatcaataccgacatttcgattcataacagtagcaaaattacagttatgaaagtagcaatgaaaataattttatggttgggggggccacaactgaagggttgcagaatgaggaaggctgagaaccactgctctaaaggaaaaactctaggaacccaagtctcaaaatggaaaaattcattctgaaaatgaatggatacctagaatcccaatcctcagaggtacccgggaacgtgatcgttttgtcttcagggccttcagctgatgtaaacggttccagatggtctgctcagccttctctctgcaaaatccaaagaggccaaaatgagcaggataggagagcaggacagcgaggagaaaatgaaagccatctgagtccttgcaaaggcatctacgttgaattcagggaaggcacacagaggcaaactgggaaagcaccacttgcaatcatcctcttccctctaacaatatcctccctacacatctcaaaatccagactagctttcaagcaaaacccaaaagctccattcttcacaagcccttccccagctcctctgtgactctcctcccttcaagtaccctctaccttaactctacttctcctgaacatggaattttgtttttgttgtttcacacatcctgtagcccaggctaccctaaaacacattatgtagcctgagctgtcctcaaactcacccatatttcttgactacccaagtactgagattacaggcataaaccaccaccccagtttatatatgatatttacttaatattttccatcagatgttagtagactacttacacacctgtcttagtccccatgtgagaccaagttctttggagcctggctttatgatagaaggttcatttccaaatctcccataacaaccaactcagtatcattccacaggtcccataaaaaatgtgtcagattaacaaactaacgtgaaaggcagctgtggaaatagtaacactaacatgccttcaacagcaataaacaacaaaaaaagaggatgtgttcactttttcttaattcatttttaaaatttgttatgtgtatgggtattttgcctacatgtatgtgctcccaccacccctgtgtctgggatctgatcccctagaattggaactacagacggttgtaagctgccatgtgggagctagggattgagcctgagtcctctagaagagcagtcagtgctcttaactgctgagccatctctcaagtctatcacttttgatgaatttcctgtgatcaggtacttcttggcaagctctgaagataccactcatatcttttcagaattctgtttcccaaccactggctacacctcaaatcaggtatatatattaaagaatatgacattagagccaggtggtggtggtgcatgcctttaatcccagcactcaggaggcagaggcaggtgaatctatgagtttgaggccagcccggtctacagagctagttccaggacagccagggatacacagagaaaccctatctcaagaaacaaaaaataaaataaaaaataaaataaaaacaaaaaagaatatgccatcagtgaccaaaaaactttaggaaatttgggacctcagcactttgggtttaaaaattctatataatgtacagagcttggtttgggcatttttgtgattactgtttgctttgtagacagtttcattgtgtagtccaggctggtctataactcacaatcctcccaacttctgcagtgcagagattacaggtgtgtattacctgtaatctgtactcagataaaatgggtctggtgagaggaaaaaaaaaaaaaaaaaaactcacagaattgctactgtgagaattaaactagtacatccatgtatgctgtacacatggaaccgaacccacaagacatgctcatcacacatcagccacttatatcaagagtatctctattacagaaaaaccattaactctcggtggcctcgaggcattggctcatctccataagcaagcctccttgacacgattacacacaatctattcactccctatggaaagaacaaatttgtacctgatagagcacgtgacaagaaggatcacatcagcctaatgaagaacaaaaaaaagaaacttataaactttgacattgaccttgcaaaatcactactatgcagtccacctacttttttcctattattatggtaaaacatacatacatcttattttaaccatttttaaggatacagtgctataataagaacactatagtgcaaccatcaccaccatctccttccagaacttcccggggaaagctttgtacccattatgcactaaccctcgagcctcaccttcactccacaagatagctttgttttgttctggtttggttgggttgggtttggctgctctggagacacagtcatgccctacagtcaacatggcctcaaattccagaccttcctgcctctacttcccaaggctgggattgcagacacgtgtgaccacaccaagtctgataacccctctcctgaagatcaacagcatcatgaaggctcaaaatagctggaacacagcatacgctagtcctacagtacacttcactcaaaggaactaactcagcaggcaacatcttctccccaaaaactcactgcatctaagaatctgcaccaaggcagggcagcccaggcccaggaaacagggaggcagggggtgcaagcacctcttggaggttgctggtccgcaggaatccgctcttctgtaaaatggaccaggctatctctgtgtcattcacgttcatctggcagccataggtctcgaggtagactgcaatgaaagggagattgagtaggcagagggccatgtgggtcttcagcctccttcccaaagtgctcagagacacctgaggcaacttgtcatccacaaagtcccctgctgccttgaccctaaaataccatcagctgccagatgtacccccaaattaataatagccttttagaacaaaggaaacacaatatcgtatacacacacctataataaacagggtgtttaaatacaggggaaatgtgccccttaagaaataagggcatagggctacagaaacaattagaacagggaagactaacgatcatttttatccatctgagaaagaactaaattcaaatccccgtattacagtcctccctctaaacaagaggtcctctaacctctgggagcagcagcactgaccagagggtacagacaccacagactaaaaaaaaaacgaaagcagacacggtcatattatgaagtaaaaatacaaatttacaccaagttccaaaacacggatttcacactttggtagaccctttcaaatcatatttctagttacaaccccattaccatcagaaggctattattccaactagaagcagggcatggggggccaaggcaggaggattatcatgaacttgaaaccagaatgagctacacagtgagctccaggcaaacctggactaaagagactgattctttctcaaaaaagcaaaacagaataggaaacatcagctcttcttttttttaagccagggtctcactatgcagctctggctagcctagaactcactatgtagaccaggctggccatgctctgcctctgcctgccaaatgctgagataaaaggtatttaccacgggcctagataattttttatatactttggaagggggggtcacatatgccatttcagaagtcaaaggacaatttgtggtagtaagttctcccctttcaccttgtgggttccagggatcgaactcaggtcatcagacttggtggcaagcaacttctgagttatcttgccagccccaagaataaaactctaaatcagaagtgatgacagacatcagtaattccagaagttaagaggctgaggcaagaggattatgagttttacactaacctgggttacagagcaagacccagattcaaaaggtaaggggcagagttgagcaagatggctcaatggttgaaggcttctgccaccaagcctgatgacacatggtagaaggagacaaccatctctcacaagttgtcctctgacatccacatgtgccacacacagagacacatagagtaaatgtgaaatttaaatggaactttaaaaactgtaattagaacacagattatagtgtttccaaaagcaaccaaagagaggactccaattcctgtgtgcacagctttgagttctagtttgtcttttgaagtgttgaggctgaagaacagagcttcaagcacgctaggcaatcactgtaacacacaactcttcccctgcccaacctatgagtttctttacagcaatgctgcttgggagagcctgatgattctgtaactgagcaacctgcccacactgctaagacagtagagccacagaggctgcgacagagaaaggaaggaagccaaagggaagggagaagtaaaactaaccttttctctgccttcctagaagttcatcccctgtgagatacgggggtgggtcctccacttctggaaaagatggtttctcttgaagaaccgaagcacttcttaaaaaatgctgaaaagttggtccggcggctagcctggagctgaaatccttctcaacaccttctgagctctgcccctctgaactaagacatgaagagctggggacactgctatgtgccctgcaggtcctgagcagcagccaggacacagagctcagtggcccccattttagagacctctgtgcttggaggacacattgtaaaggatgcatgacacctgtggtcctaaatctgcaaaagagtgaggcataccaacatttactgcacactctatacaggtactactctggacacttgcccctcacaaaagcagaagagaggatgctttgggggtggggtgggggcataagaggtgttgagacaatcttagtattatcctgagctggcctggaactcactatgtagtccaggctggggggggtctgcccctaggttttgtttgttcatattttgagatattggtctatagtgcagaccagcctcaaactcctcatccctcctgcctccgtcttccaagtactagaatcaccagcatagaccaccatatccagttcaaaagtactcttgatagtttaccttaacccaagcatggtaaaactgcagtctcagtgccttggaaggataaggcaggaagatcatttgagcccaggggttccaggcctgcctggacaacctagcaaggtctctaaaaacttggtctcgggctgaagagatggctcagcggttaagaccactgactgttcttccagaggtctgagttcaattcccagcaaccacgtggtggctcacaaccaccttaaatgagatccggtgccctctgctggcatgcaggcaaaagactatacaaaataaataaataaaatcttaaaagatttaaaaaaaaaaaacttggtctctcatgctggacgtggtaacactcgactttaatgccagcttttccgaggcagaggccagcctggtttatagagtgagctctaaaacaaccaaggcttcacagagaagaaccctgtcttaaaaaaaaaaaaaaaaaaaaaaaaaaaaaaaaaaaatggacaagggacaagatggctcagtgggtaaaaatgcccgaggctcaagtctgaaatcctcagttaagagctcctgaacccaccgtgaatggaaagaactgacagtggagagaggaatgactctgaccatcacacgctgtgcgcacactcacacacacataatacttttaagaagtggggcgggaggggaacgacccaaagaggcatactaagacttcagcaaccactcatttacacctcacacatcttttcacaggatgggccttaagtaaagtcaatgtgactgctgcctggccaggcaagccccggatcagggagccttctttaagagcgttgggatggggcagcgatcctctctgtggaacctggtgggggcatcaaatgcaagcttaaaggtttgcaccgcacagcgcagggcggagctcttaatgtcagtgaagggggcggaaccgcccgccacatccaagcacgcgattgggtagatactggtgctgggcgtggcaagggggctctgcgtgcacgcccacgagaacccccgcagccacccagcaaggccggtccgacccccatctctgcatcccaaggggagaggctagggctccgaaggacccggtgacttggccaagcgcatacagaagtaggcagcgggactgagctacattcgcagcggcctctctcggggcctcacgccgcccagtgacaccttcccccagtgctcctggcttttccgggacgccgcgagcgcgcccacgccacggcaggtcacccgcagcaagtccctctcaagcctctcacctcccacaaccgcgagaccccgcgtccgaaccggaagctctgtccgctggtgagggtcgctctcaggcgtcctcctctgcgcgccgaggcgtgcaacttctgttccgccgtgacttccgccaacggtgttctaacggaagtgtttcctaccggcctggtagactcaagctacgggctttgaaaaatatttgggtgggaaacccaattatttatatgctaaccaaaaaattttaaataaagcttaaaaaccaggttgggccgagcggtggtggcgcgcgtctttagtcccagcactcgagaggcaggagcaggtggatctctgagtttgaggccagcctggtctcagagagagttccaggacagccagggatacacggagaaaccctgtctcgaaaaacaaacaggttgggcacgtgggcaccctgagagtctgcatctacccttgtcccaagaaaatgagggattcttaggagtgttctgcccttggaaagtaggggctctaccttgtcacccgtctgtcacatgtactcctttcctccctgcaccaggcccttaatggaaaggggccgatggggctggtaaggtggctcagagtgtaagacacctgctgccaagcgtgaggacctaagttcgaaccccagaacatacaaggtgaaagaaaattgactcctgcaagtcctctgacctccacaaatatgccaggggacattcgacaccccccccccaacacaccaacacacacacactcacacgcacgcacactgtctcttggcgaggtatcacactttggtaactccaacactcaggtagcagagcctgacagcctgagttccaatccccagaatccacaaggtgaaagaagagaattgactaccccaagtcctctgacctccacagatacaccatgggatacgcaaccccaccctccggccgccaaacacacacacagatacatatacattaaatgtctcctggcccagcatacttcagtaatcccaacactcaggaggcagaggcggctggtctttataaattcaaggccagacagagatacatagtaagactcggtctcatagtaagtaaatgtaaacgaaattaaagaggggtttctgtggctacctctgaactgcctcacctttcctgaatctcccaaatggccttggacagctcagttattcctcaccacgtctttgcctgtcacgtggctgggccttgacactctcagccactctcccttccctgtggttcatgcctctagccaaggtgcctcttctcccttagacctaacctatagactccacactcaggaaaatgctgagagcaggattcagacagaccagagccctgaggtgagaaccaccctgtgtaacataggtgtttttcaagctccaccataacacctagttttaaagtgtaaacatgtggttgaaacacaaattgcatgtggaatgtggacagtttaaattccacaagcctggcatgataacagaggaaaggcgccccctcctggcatgttcctgtcactactcccaccaaaacactcgatttgggtggagggaaggagaggggcattcccagccttcctctggaacaataagtttttgttttgttttgttttgttttgttttcatctgtgttgtgaatctgtgcagaaagtcagaaacacctctgtgtgggaagctggaaacacctctgtgtgggaagccaaaaaccccgtagcctccaaccgaagctagagtaactggtttctttagtacggtaactctgaaaatctgtgtagggcattctgggcctcactctccacctcattctactatttcaaatatacagatagtgctatggtctcaatgtggtgtctccctcaaatccacatattgaaactgtaaccttcaagaaaatggtaataggaggtaggatctttgcaaagtgattaggccataaaggcagagccctctctcggccttagcaccatcttgcttgcaactcttgcgccatgagatcaaagtggaggaagaagccaatgtgcaggctgaagcacaagggaagaaagatgaggcagaggtccaagtaaactagctcatccacccacgaaggctgaaggagcagaagtaagggactctgaagcctgggaggctggtacaagttgttggactgtgtgctactgttgctgtaagtctcaatggacctggaacatcaccatctgctcacagaaaccacctgagacacttgactgttgacatcacaaccaaaacagtcccgctggcctctgccctggacctgtggcattctggactcattctgttctcacatgtggccaagtgtaactcgtacacaataaatcatctaagcgtgttgtttccgtagtatagtggttatcatgttcacctcacacaaaaaatcatctttctcactgtctcagctcaagaatcaaaaactaaataaatggatagatagatagatagatagatagatagatagatagatagatagataaaggcagagccctccctcatgcagaaacagaggcaggcaggtctctgtgaatttgaggttaagtctggcctatacatatctagctccaagccagcctgggctgaatagtgagaatttgtcttgataaataaataaacttttttttttggttttttgagacaggttttctctgtgtagctttggagcctatcctggcactcattctggagaccaggctggcctccaactcacagagatccgcctgcctctgcctcccgagtgctgggattaaaggtgtgcaccaccaaagcctggctaataaacaaacttttttaaaacaaaaagtgtataaagaggtatgctgcacatgcctataacagtgcttggaaggtggaagcagaagaatcaggagttcaaggccagcctcagctacattaggagttcaaagctagcctgggctacgtgtgaccctatctcaagaatttgtatgtgtaaatcagcactcaggaagcagaagcaagaggtagggaattcaacgctacctagacaatatggtgagttccaggcaagtctggagtaagacctgtctcagaaaattcctttttgatttcataaaaaaaaaatatatgagattaactcattttacagacttaaagatgaggaatacaagagtagtcacatacaaaggctcacactacaagacagagctgtgcagtagttgggacccacccatagttcagtctgatcccaaagtcctattcttagctctgactaactcaacctcagactggctgggttcccgctggggctatgcttctgacagttggataaccatggccaactaatcactgctgactccagtgtccttgcctacaaagtgccaactgtgtggtgaatacactgtggtgaggcatggggagaaaaagggtaaggaggggccaaaggatcagaaaggcactggggctgtggcagtagtccagagatcaactgtggattcctaggccagtgtgggatttggggccgtgaagtttgaaaaaataaacaaaaccctatgatttcaggagattgggaacctcatattctctctgctttaggacctgatgttcatccctctttcaccgaattctactggctgctgaaagttctgatagcaagcactcgctcactcactcactccccctccaccttactgtgagcagggtgtgctctccttctcactgctgacaggcagatggcctgaatgctctatgtgattgactgttcttcacactccactggcctaccgcaggatgaggaaccccaatcaacagccaggagcaaaagtaccctgctctcagcccagttttaactagtaaaactgtagtctaggcacagccaggacagtgaaaataaatgcctgttgttatagccatggagattgaacggggtttgtttggtgcttgtgccgcagtgttctctccggagaaactgactgaagcgtgtttctataagctgtccctgcttcagtgtctcctacagaaatgagaccagctgatgtcccaccatcctctccacttactccctgtgtctgaccaattggaatcacacatttgattttgatggagtttttcctgctgaggatagagacctgctggttttacatcaccaaagactagcacaagatgtatcctagatacttgtaggtgacccgtgggttggtgggtgcaggagtgagatggatgggtaagccagactggaaaatcttcacctacatgcatctccccatttcttggtgcctaatttccaaacatgctaattaagtaacttcatgggacaatttcctcattgaatgaaatttcttgagacttcaaacagaaataaattcaactcaggcactcttagatttcccacccccataatgaaaaacataatgaatactagttgctttgagctgctagattgcacagtcgtttgtcacagagcacagataaagcctgtattcactttgaggcccagttctccagaagggtctcacatcttggtctggttcctcttgggactgcagagccacctcagagtccaaatgtcaagacacaaaccacagacatagagccaggccgcctctgtgtcacaggctgtttattatccaagaagaaggaggagagagagagagagagagagagagagagagagagagagaagaggaggaggaagaagaggaggaggaagaggaggaggagaagacagaggcccccctgggctcaggagaaagtgaacagaaaggttcctcttcttcctcttgccactgaccagctgcagagatctcaggggtggcataggggcctccaggaggcctggcagctctgctgttgactggagacagaatccccacaggggcaggtcccagggtcggaatggcttctgtgtacacaaaatatctctcttcaaaaggcactggtggaggtgagcagtaggaaggctgccccgtcgcaagccagacccactgtcccaggtctgagtcctattccccaagaccaaaccggccttcctcaggctggtctgtagggcccgtgttcccctcctctcccttccctcagaccaaagatgagtaggcagtcggcagaaggacaagtcaagtcacggggtaagtgatcctcttcagggctagtgcatctgacaacttctaggccaagagccccaagcgggtgactttggccgagaggaaggagtggatgataaagaccatagttttaggacacgaatgcaggtccagctgctgcagagtggacagagaaaagcatcaggggctcttnnnnnnnnnnnnnnnnnnnnnnnnnnnnnnnnnnnnnnnnnnncccgggctgctcctggctcagctgcccacagcgtgaagcccttgtcgatgtgcacagagaggttacagggacggccattccacgtgcaggctgcaggagagcagtgaacacaggctgctctgaggctacttcaaagatcacaagctccactcaacttcaaaagaagcccccagaatctggcttgatttcccccagatatgggaggctcactctttcatcacacctgaacaaccacctgcccagtcacccctatcctaaaatacagaagagcaggccttcagagaacctccagctgcatctagccccacttctagcacatgtgttggagaagcttgggctggaaggctctgtgagagaggattcagctatcacgtgcaaggtcttgggttcaattctagcacaataaaataaacgagagttaatttctgcgatgtacacagtttatcccataaaggcacaggattgcctggttaaatttaaatctatgaaatttaaagtgggtaatttagattgacatataaataagtgttcattgtttacctgaaattcaaagctaacactggtatactatcttacctatagcctcacccccaagacagattctcacagtgcagccctggcttgcctggaacttgctatgtagaccaggctggcctcaaacccacagagatccacctgcctctgcctctgcctctcaagtgctagaattaaaggggcacaccaccatgtatccttacgagcagaatcacaaggataacataagaaagactctaagaaaaaatgtctcccttcctcccagagcacttgcataccccaaacagggacctcttaaaaggcccaacctccattccttattcccctccacaaatgtcataaagaaaaaaacaaacaaacaaacttgaacgcctctaggcacaagaggctccacctggcacacctgtagacacttcctgtacaccttcggcagcccgatggcagccatccaccagctgtcgagtccaggctgccagctcttgtggtgactccacactgaatagatgagtgtccacaccgtgacgtgtgcccgtgcgcagggcaaaggagagttctgcgtcatagagcactgagcccttggaggggcccgagtgcaccagcctgtatgcagagcagagggacaagcatgagactttgaggtggggtggggtggggtggggtggggccagggaagtgacctgcatccttcagtatcttacagaggacaggaattacagggggtgtgtctcctccaccttcccctgactcacttcaaccttagtggagtcctcacagatactgtcccctccctatctcccactggctcacttcttcacgtcctgtggatctttgttcaaatatcccctcctctgagaagatctgtctaaaatagctcctttgtcactcactggccttacttttcatcaggactgctgaaattatgcattttgaatgcttttattatttgagcagggtctcactaggtagccttgctagcctggaattcactgtgtagaccaggctgatcttgaacttgccttgaacctccagcttcagcctcctaagtactagaatttcaggtatgtgcccccacactcaaatgtaattatatattttacttattagtttcagtaggcttttgcctttttccctagaatgtctctaaaatagaagtttttgtctattttatgcaacactatattcccagcaatttaaactgagcacatagtagctgtttaataaataattgtcttaattaacaaatcacttgactaggcaggcaatccaaaacctgccacttgtccactggccgagaacccaatccagagagaggagacatggaacaaggaccccagaccttgcagcttgattctcatttgctgctgtggccttaggcagttcactggccctctctggccagcagacctctacattatggcccttagcaacctctgtccctcactctacccactctgtttgcctttagagcctctactaagtcccacactcctcagacccaacagccaccaagcctctgagccacattccctatgtttccacatatactctggacctgactcagcatctcgttgctgactcagcatcccattgaacctcctccataggcaccctcactccagacccactgcccacaccaacgcacacactccaaacctcctattcatccaggacgcctcctgccctctcccatctggcaagcactgagcctgtgagttcccacccatgcactttctactgcaaatgccatgattcttctccatatgcttcctccaccccctgcttccctcagcccatgtctcccaaagatgtggcaggctctcagctactgccctcccctccccagcataagtcctctgtggcaggagtgtcctctagaatacagctagtcgcagtctcctgacttcccagcttaacccctccagcgacactgctgggactggggagatgcctcagtgggaaaagtgcttactgttcaagcatgtgaacctgagtttgggtccctagcatctatgtaaaagccaaacatggcagcagacacctgcagccccagcgctaggggaagctgagacaggggtcactggcctgtcagtctagtcaaaacaagctctgagtccaatgagagaccctgtctctaaaaaagaatatggagtgggcatgataacacatgcctttaatcccagcacttagagcagttcaaggtcagcttggtccatgtgcaaattcctaaccagccatggatacatagtaagactttgtctcacaaaaattaacataaatacatatatatacaaatatatatatacataaacatatatgtatatatggtaaagccaaatgtggtggcatatatctgaaacctcaggactggagggagcagagacaggtggattgtgtgaacttaatggctagccagtctagccaaaaataacaacctctaggtttgatgaaagacaaagtctcaaaaaataaggtagagctaaatagagaaaggtacctgaatatgacttctggtttctatatttgtatgcactcacgtgcatgcacacacacacatacacacacacaaaaaaaaaaaaaaaatcctgctaacacagtgttccttcaccagacagcagctctgtctctttcccccccagttcccatgtggattctgtatgtggttctgccacatttacaggtcatgaacatgttctagccctccatgcctctgtacctctggccacacctaagatgctctcccttgcttcctcaaaagctacagttcttattcatcaaagtccatttcaagtgtcaccttctccttaagtcttccctggccaagccagacagctaagtgtctcctataaccttcaatgtaatggctagacatacataatggttattctgggtttgtctcctgactgactccggattctccctgagggcagtaactattcatgtcactgtgtgtcccctgaaccgtgcagtacaagatgaaggtatcaataactgagtgacagttagcacttcacatttttctgttctgagcctcaactttataaatgggggaaattgtggctgtagggagcagaacttgcttcagatcacctgggaaatagctggaggcagaacagcactggggtttggggcttctggggtccatctggaacaccaccctcccaagtctgagtataacaccgagcgttcctgctcttcagtacctggtggcgatgagcggggcagtacgggctggcctgctcagggcctctcgagtttgggggagagagcagtaaaggagcaactccttctctgtcagcagggccagggttggggctgtacctccactgggcaactgcaagcaaaaaggtaatgaggacggatgggatgaaagaggtcaaagggccgggagggcatggggtgataaggtgtgacagaaatggggcccagcaagcacctgttctgtcagccagccaatctgcttgatgtcctggctcccagctgtacctgtggctgtcagcagtgcctgcagctcatccttgacccaaggtatgaaagtgctgatctgggcttggatggcacctgcccatgaccttgcactggcctcatccttggccctcaagaacagggtatcctggccatctgctgcccctatctccagatacctgaaggcacaatgggataaaagataggacatgtcactggccagctatccatcccagacatctagttcaagaaagccacccactgccaaactggaagaagccacacaggctgtccatgagagataaggattgtgtttagggctgaagagatggctcagaggttaagagcactggctggccgggcgttggtggcacacgcctttaatcccagcacttaggaggcaggggcaggtgtatctttgtgagttcaaggccagcctagtctacagagcaatttccagagacagccgcaaagaaatcttgtctcaaaaaaccaaaaagaaaaaagaaaaagaaaaagagaaaaagagagcaaccaggtgtgatggctcccgtctgtagtgtcagcacattatcaccagggtgggtatagaggcattgcagccaagctcagcaacctgattcccatgggagaagagaaaagttgtcctccagccatcacacatacattgtggcatgtgcacatgcatgcacatacaaaataaacaaatacataaatgtaattcaaaattttaaaacactgaactacctaaactatacagaccccttctcgaaaaagaaaaaaagaaaaaaagaaaaaaaaaaacaggttgggaaatgagataaaatgggtagagagaaaagaaacaaaaagccatgccatcaagtgtggagggagagcaacagtgatactggaaaggttttccaaaatgttttgtgttccgttaaagattcgctcccctttggatttctgtactacaaggagtagggcagaaaggggaggctactcccaacacctagcccatccagctttgcccctgccttcctctactgcagagctgaaagcaaaggacttgagtccatggattcccttgcagttatgccagccacatgacccagttctaacctctgaggctttgacagaggtctctggaaatcaaaggaaaacctttccaaagacagaccaaatccacccctcgctacacacattgtctagttctcccagcacaaggatgcaattcaaaataccagatgtggtagtacaccctgtaatcacaccactggtaaagtgaaagcaggaggatcaagcagaagttcaaggtcctcctgggctacacagcgaaattgagaatagctccagctacttgagaccctttcttaagaagaagaaagccaagagaaccaaggctggaagccaggttcccaagttcctgctcacctgttaatttcccagaggaagatgagacaaagggcagtgtggcacacacctttgatcccagcgagaagagaagagaagagaagagaagagaagagaagagaagagaagagaagagaagagaagagaaaacaagcagtgcataccatcaccctagagttaagtcatgcgtccatttgactcagttgtgaagcacctgcttcatgccagcatggatgctggtatgatgtttgtcacttacatacaacacagatatccttcgtttgtattatctgagtgcctccccactccagcctcacctgggttccgggtcagtgggcgtgcacctccttgagacatatgccatcttcaaggatatatgtttggcctcactgaggttcctgggctggggaccaggggaagaaggctgacgctgaagaggtgaggcaggaggtgagtcccagccaaccgaggtcccgccagcagaattcttgaaatacggtgagacctccttcatgtatttaactggcaagaagagaggccgcctgttaccattgctgcatgaactccatgtagcatatatcacaattgtcgctagttaattaaaagcttactttatggagctggacagatggcccagtggttaagagcactggctgctcttccagaggacccagattctattccctgaacccacatggcagttcacaactgtctctaactccagttccaaaggatccaatgccctcttctgacatcaatgggccattcatgcaaatggtacacagacataaattcaggtaaaatactccaaaacataaaatagtaaaatgaaaataatttttaaaatagtgcagtccataaacagatgcaatcatctcagaattgctaacatcagacttggaacccttacctaaacataacatttgagctatcaagcacaggtaaacacacactctctctctttctctctctctctctctctctctctctctctctctctctctctctctctctctctttctctctctctctctgtcactatttaaaatttttaaagatgatgtttgatttaaagcaaaacatcttccaggcatggtgatatcagacagaagcgtcaggagttgaggtcagcatgggtgatttagctagaccccatctcaataatcctacttcaaggccagcctgatctacagagcaagttccaagacaaaaaagaaaaaaaaacaaagtaaataaaataagcacatgactgtaaaccaagcatttgagagctagaaaaagagaaatcaggagtttgagactagcctgggccgcacaagcccatctcttcaaaaaaaaagggggggggcaggaagtgactccagcagaatacgtgtcttccatgttcagattcctgagttcaatccttggtaacacacacacacacacacacacacacacacagagagagagagagagagagagagagagagagagagagagagagagagaaagaagcaatggaagggggtataagaaatgaagacagagttgtatgatggttcacacctgtaatcccagaactcaggaggatggggcaggaggattgacaagaattggatgccacagagtgtggctctaaactgtcctaatgctgtagccctttaatacagttcttcacgatacagagacacccctcaatcatagaactatttcattgctactttataaatgtaattttgctactattataaattgaaatgcaaatatctgatatgcaggttagcctatatccaaccctgtgggggtctcgacacacgggttgagaaccattgctacagtccaggcgtggtagcacctgcctttgatcccagcactccagaagcagaggcagtggcaggggcagaggcaggcagagcctctgtaaattcaaggccagccttgtctatagagtaaattccaggatagtcaaaaccacacagagaaaccctgtctagaaaaaaaattttaaaaagcaataaataaatgtaatatagaataaaataaaaagtaggaagaatgaaagaggatggagagaaaaaggaagagaggaaggaaggaataaagggaaggaaaaagaagagaaaaacttccactacattcttggccttttaattttcctttcagatttacttattttattttatgtgtatgaaagttttgctcaaatgtatgtctgtataccacatgtgtgcctggtctccttagcagtcaggagaggacaccatgaatgccatgtgggtgctaggaattatgcccaggtcctctgcaagaacaagtgctcttatcggatgagccatctctccagccctgttgttggcctttttgaaacagagtctcatactgtcctccccaatactggattgtaggcatgtaagatcaagtccagctaatttttttttgagataaagtttctctttgtagacctgactgtcctggaactcactctgtagaccagactgaccttgaactcagagatctgcctgcctcggcctaggaatgaaggggtgtgtcaccaccatcccctggcttacttttattatctttaaggcacagtggttaatgggtttatttcttacatgggcagttagtatcttaagcagtatatgtgcccagggaccctggcagatctcacaatatcactgagagggtacagtggaccttctgtgatggttgaaatgtattgctctatacaaaagagtctgcctctggtcacacactgcaatgagtacatggaatgagaccagtacaaacagaattgcttaaaagattgtttttttttttattttatgtggctaggcactgcatgggtgcaagtagccacagacaccaaaagagggtctcagatcccctggagctggtgttacaagcaattgagagtccacctgatatgaggactgggaaccaaacccagcccctctacaagaacagcagttctcttaaccactgagctgtctctccagtccctaaacagaatcaaaaaatttttactgctgcaattaaaattaattttagaaaccaggtgtggtggcccacaaacactggtaatctcagcactcatcggacaaaaacaggaaggtctgaagttcaaggtcatccttggctacataaagaatccagagccaatatgagttaaacaagactgtctacaacaagccgggtgctggtgccacacacctttaatcccagcactcaggaggcaaagacaggcagatctctatgagttcgaggccagcctgatctacagagtgaattccaggacagtctccaaaactacacagagaaaccctgtctcgaagaaggaaaaaaaataaataaaaaaaaaaaaaacttagggctaacaagaggctcatcaggtaaaggcacttgccaccaagtccaatgacctgagtttgattcctagaacccatactgttgggaggtgagaaccaactctaaaagtcatcctcttcccttacctccatataaacactgtgtcatacccccatccctgcctaccagtaaacagtaatttaaaacaactagaagtaaactcaaatagtcacagagaactaagggcaaccacaatgggcaggacagtcctagaatatatgcttctctgacatgtgaccctaccctacaagctgtgctagggacaggaaaggacatctgagccaaaaagctgccagactgggatccaaagagtgtatcctgggagttggatgcaggaggatcccaaggctaagattatatccagttataaagcacattcaaacccaggacctgtctcaaaagaaatagaaacaaacctggatggtggtggcgcacacccttagcccaggactcgggaggtagaggcaggcagacctgtgagtttgagccagcctggtttacagactgagtttcagaactcccaagaactgttacagagaaacctgtacagaaaagaaaagaaatagaagcaaagtcttgagattggccaggcctgaggaattcagagtcatccttaactatatagggaatctgagatcaatctgccttttataaggagagagaagacagaatcttgaggaggcattgtggctcacacctgtaatcctagcacttgggagagtctaaggcaattgaattgtcaagagttataggttagcttgggttacagaattaggccctatcttaaatgactgaaaaggggaaaaaaaaaaaaaactaaggaagggaatttagctttagttcaggggataagtgtgacactagtgtctgggtcttactcttgccttcactgtcatagccacaggaggactgccatagctcaagtcgatcattccttatgtcacaaaatacaaagcaagaagagaggagaccagcagaaaaatggctgtttccttgcatctgtctaacaggtgcctgtggaggccagaggtgttggatcccctagagctgaagtcacaggtggttgtgagcaactttatgtggatgctgggaacccaactccggtcccctgaggtcagtgttcccacctggagagaacactgtcagggcaagaacttcatgtgactcatctatgccctcagaatccggctggcttctcatatgctacatgctcagcaaatgaacatttgtcaactctgaagccaaagaaaccattagagtcaccgctcgtctggctgtccctgaaccaggtcatctttctccattcccacaggaatgtactataaatgaggagtgttctagctggtgccagaaacagagcttggatttcacagaccaagtgacctctccctgaatgagggtggaaacctgggggccccagagtttggccataaatagcccagttccgaagttgcctcccactctgatttctgcctgactcatttgagcagatagggtgggactgactacagactatggcttctagcactgagggacatgactgtggctggtcgccagggtcatggaatctatgacgttaggcccagccagagtccacattctccccaggcaagtctctggcccagaagcctggacaagctcacacaggaagctgaggataatgaaggaagccagaggttagctctggccccaggacacaggaagagattccactcaaggcattccactagattctacaatggagcaaggccatacccctgcccagtttaactaagagcacagggtctcatatgtcttgctaagaggagtcatttgttttggctcaatgcaaaaaatgttcagaatgcatcccagggctcattaagtgcctgtgactaaatgtcctggcctggaatcttggaaaatctgttggctacgctcaacctgttccctgtctgttcagagtgggtggttacttcccctgttgaaattatactatggacttatctttttactaatctaaggcctctctactctaatccaaatgtcaatactgtgaacagaggaacccaatctcattttccagggcacacccagcttctactagcatttgattgacctacactagctagcagaagaataacacaaaccaagtgtggtaatgcatgcctgcaattccagcactggtggctgaggcatgaagagcaacattaagaaccacataggccgggcagtggtggcacataccattaatcctggcactcaggaggcagaggcaggtggatctctgagttcaagtccagccaggtctacaaaacaagttccaggacagccagtactgttacactgagaaaccgtctctaaaaaccaagaaccaactagccttaactctagttcccagggctgtcctgccttctaaaggtgctaggcacacaagtagtatacatatgtttgcagacacaacactcatatacacagagaaaaaataaatgtctattaaaaaaaaaaacttcttaaaccaagtagtggtgcacacctttaatcccagcattggggaagcaaaggaaggcagatctctatgagtttgaggtcagcctgatctataaagatagttccaggacatccaggtctttgaagagaaaccctgtggggggaggggggagtggaaaccttccttccttcttttaaattttatgtggctaggtagtgcatgggtgcaagtagccacagacaccaaaagagggtctcagatcccctggtctacaaagtgggttccaggactgttacacagagaaaccctgtatcggaaaaacaaaacaaaacaaaacaaaaaaaaaaaaaaaaaaaaaaaaaaaaaaaaacccaaccaaccaactaaccaaccagccaacctgccaaaaataaaataaaataaaaaagacaagtatatattagcatgtaaaaatgtttatgataaaagcctagactaaaaggaactgctattacttttaattatatatatgcacatgtatatacatataactacatgtgcctttggaggccagaaaagggtggcctcctcttctgtagctgtggttaacagtgtgaacagcctggtgtgggttctggaaactgaaccaaagccatttgcaggagcagcaagctttcctagtcactgggccgtctctccagctccgagaataagtaatgtttcttaagtcctgcgctaagaagattctgactccaattgaactgatttctatctgttacagaggccactattgcctcagtcttggatgatactctctgccatgctttttccctcccaagattaaagaataatgcatgtaggctgggtggtggtggcaaatgtttttaatcccagcgctagggagaagggggcagtaaagccaggcagatctctgagttcgaggccagcctggtccacagagcaagttccaggacagccagggctacatggagaaatcttgtctcgaaccctcccccaaacagagtaattcatgtaaagccaaagccagcccattcataaggatgacattctgcatttcaagcatctaggctagaagttgttttttccccagtgctggaatcaaacccagggcttcacagtcagggacactcggagaaaccctatctcaaatatctcaaaaacaaatcccaggcccccatgtatgactggcaagtactgtaccaccgaactattcctccaacctagaaactctccgagagcagaagccattgtgtacttctgagccctaccgcctcctccagggctggcactgagctctgtacatgttggatcttgagggtgtgtgaagattgactgagggggaggggggtacatctctgaccttttgtactttttccacaacgttcctgattgcaggtgtcattcctaaatctttaagaaggtctccaggctcattctggcttgtgaaatttgagcttttctgttatgggtccttggaactccgaggccagccaactctgctgctcctctaggagatagacactgctgtgtatcccatgggatttggctgcacatgttaacagttttaaagtggatgtagttaatttttggttacctattcagaagagctgagtattctgcgcctcttaggtgccagagggacttctgtgcctggaacagacataaatggaaaccctgtctaggactcccatgaatgcaaagacctgttattctgaccattgttctcaaggagacatttttttggctgcacactcataactttggatcatgtgactccccacagacaaaagttggcttaatccaaccctggcctgatctgcacaactcaattgaaatgcttggctattcccagtgagatggctcaataggtaaaggcactcactgtcaagcctaatgacctgagttcagtctccccatgctggaggaagagaactgactcctgcatgttcttctctgacctatgcacatgtgtgttcattcacataagcacgcacacaatacaaaaaattaataaaaataattagggctgggaagtagtacagtggcagtgtttacttcccaaaaccatcacctctcccacaaacaaaacaaacagaaaaacttctgggtctttagatgaaggttacttgcctaaagtcacagttgcctgcctggtctaattgtgagttccaggcaaggtagggctacagagtgagaccctttctcaacaaacaacaaaaacaattctttctcccattattaagatcctaaaactcaggcaggaaggtggtggcatccactcttaatcccagcacaagggaggcagaagcagaggccaaaggatccctgtaaattcaaggccagcctagtctacaaaacaagttccaggacagccagggctgttacacagagaaactctgtctccaaaaaacaaaaagatcctaaaactttagggccagcgaggccagtgatagggctcatcaggtggtgagtgatgacctcagttcaatccccacaacacacctagagactggactctaagcttccctagggacccacaactcatgcatcaccaaaatcacactgacacacaaaatcaaaagattgtagaactctgattctagaatttctgagttggaaggggccttatttatggatttctttatgtttttgtgtgtatgtgtgtatgtatttatgtattgcatgcatgagttgcttctgcatcatggtgtacatgtagaggtcagaggacaacctggccattagattgtcaggctaggctgcaagcatctttacctgatgaaccatctcctgagaaaaataaagttgttttaaaaattaaaaagcagcatacactatccagaatgaaacaacggggaattaaggaggtcacctcatagtcagggctgagatactactcagtggtggagcgcttgcccatacataggaccttgggaggtggaggcaggaggagttcaaggccagcctgagctatatgtttaaacaacaagaacaacaacgccccctcccttccatcccaacttcacaatgataatctctattgatatttttacatcggggaactttatatgcttgtgcttataagttaaggacttgtaactttttgagatggggtcttattatgcagccctggttatccctgtgtagaccatacctggctagtcttagcaatcctcctgcctcagtcgcccaagtgtgtcactatatctggcttttttattttattttattttttttacagtgccaggtatcttgccacacgcaggtaatatgctatgcactaggagtatttaagaacattgcttctcagagatttgagctcaaaatttatatttttatttatttatctgcttgtttttgagaaagtgtgtagccttgacttacctgtaactcactttgtagactaggcaagtgtgaccttaggtaagtaacctcacctgagtttcagtgtcctcattttcactcaagggggtggcattgaggatccaatgagatgacatagggaaggcacttaacacagtgcctagcagccgggcgtttgtggtgcacgcctttaatcccagcactcaggaggcagaggtaggcggatctctgtgagttcgaggtcagcctggtctccagagcaagtgccaggataggctccaaaagctacacagagaaaccctgtctcgaaaaaccaaaaagcctagcatgctttggtgtcttgtaccatgggatgtgcccatgctaaacaaatgtgctagtcctttatttctcaattaaaattttaattatgtatatgtatggttatgggtatgtacatccgagtataagtacccatggaggccaggggattgaatcctggagctagagttacaggcagttgtgagctgcccaacatgatttctgggaactgaactctggtcctcttgcaaaactgttcatgtccttaatcactaagccccattttttttaatttttaaattacacctttgtttattttgtatgttaatgtgtgtatgatgtttatgtgtaagaatcactgtgcatgtgtggaggtcagaggacaacttgtgggagtcagtttcctccttccagcatgtgggcccaagggactgtgctcaggtagtaggcttaacagccagcacctttgcctactgagctgtctcatgggccctctgtcatcgtcgtgtttgtgtagcctccttggcatgattacaggcaagctctaccatgctaagttcactcattcttctagcaaatatttcctctttccttctggtccaggactggatgcagacaccagggcacagaatgacatgcaccagtgagggcgctcacattggtttgtgctgttgatgttcatcacagacatgcatgttgtccataggctctcacatcctagaaaaccctgatacgactctgtcatgtacctatgaatacatatttggagtgtggttcatgggagggactactgttagaaggaagggtttgtctgccattagaatctcactcctacccttccaagtcttctcgtgtcccattcactatatctgcttctcaaacccatgtcctcttcttctataattaaaattgtttatacacaaatgccctctatcaggcagctgatccctacagaaaactgactcggtttttttattaattaatttattttttatctgtgttttgcctgtgtgagggtgctggatcctggagttacagacagttgtgagctgccatgaaggtgctgggaattgaatctaggtcctctggaagagcagccagttctcttaacagctgagccatctctccagctccagaacttactccttcagtagccagtaactgcctgtagctcttcagtgggggtggggccttctgaacctttccccatccctgttgccatgtcaacttggtgtgtgctctaatcaggcaactgatcattgacagttcatggtcacagcatccctgtcatgtccagaagactctatctctgtagcaattcccttggtcctctggttcctacaatcttttcaccccctttttgttttcccttagccttaggttataggggttatgttacaagtgtcccatttgaggctgggcacatcaaagtcacttagtctctgcaccttgagcagctgtggttctctgaaatagcccctgaccatcacaaaaggaagattctttgatgagcattatgtgctgcacttagaaagcacacaagccagatggtggtggtgcacgcctttaatcccagcacttgggaagcagaggcaggcagatctctatgagttccaggacaggctccaaagctacagagaaatcctgtcttgaaaaaaaaaaatagtccctcactgtgttgcccacgatggctctggctctaaatgctcagatcgattttcttgttcagtctcatgagtttacgatttgttccaccctggccatctttttgtttatctttaaaagccataatctctgtattacatgtaactctcccactttcaataaagcacttagacttactttatgagtttttactgtgccttagtatttttttatttctatgtattttatgcatatgagtgctccacttgcacatatgcccacatgacacaagagggcaccagctcccattatagatggttgtgagccaccatgtggttgctgggaattgaactcaggacctctggaagagcagccagtgctctaaaccactgaaccatctctccagcccccaattcttagtattatttttcaatgaatgacagactcactactgtcactgtcagtatgttcagccaaactggaaaacgaacgaaagaaagaagggcattttccttgtaggtatccctccctcttctccctggcctggtctctaagggcccaggctagtcctggcatgagatctgcacacacaatgggcctctctaagcagcagacagaggcatattggctgccagcttacacccaggctctagtgacaaacatttccctgtggctgaaaaaagcctcagaagatttgtgcagatccctgacttagcagaaaaaaagctctaggagacatgctcgggtctccaactcagcccagggagggaggcctattggaaacacctagagttcactggtgacacctgtccttactggacattctcagggattctatatccaccaagccaccttgccaagttcacatccaaatgacagaccagccttccatggctcatccaagaagacttaggagtaggttggggaatggggaagttgcaaccagtgactgggctctcagggaaccttggccctggcaagcccctaagagccctggttccaaataggaaaaattgagtgcctaattcatacaaactcctcaaagtctcaaggaacaagggcaacccagcatccatctgtcctccaggcttttcaaatcactcctgcagtgcagacttgagcccagttcctcacccagcctgtggtgctgtcctgaaggaaactccccctttccatgagacagttggccagaagaccagctcaaaagagacttcggggctgggaacagagctcagtgatagataacctgcctagcctttaagttcagctctagcactcccaccaccacaaaacaacagggagctgggagagggagggagagaaaatgagagttcaagtaagaaaaactggaaagctgaacatagtgattaagacatacaacggtggctcacacctttaatcatagcactcagaaagcagaggcaggcagctctctctacagagtgagttccaggacacccagggctacacagagaaaccctgttttgaaaaaccaaaaggaggaggaggaaaaaaaaacaaaagacatacaatcctaatagctaagaggctagggcaaaaggtgggtaaattcatcagcctgagctaaacagtaagactctatcttaaaaaaacttttttaaggggctggagagatgactcgattaagagcactggctgttcttccagaggtcctgagttcaattcccagaaaccacatggtggctcacaaccatcccttatgagaaccagtgccctcttctggtgtgcagatatacatggaagcagaatgttgtatacataataaataaataaaatcttttttaaaaactttttaaaaagacatatatgatggtatatcctttaatgccagaagcttgggcatcttatgtctgtgagtacaagaccatcctggtcaacatgagacactgtctcaaaaaaaaaaaaaatccagtcatgggggctggaggggctagagtgagctctggcagttcagagctcatagtgctcttccagaagacccaagttcagtttcaagcacctatattgaacggtaactccagttctagggaatctgacacctctggcatccaaggtcacctgcactcacatacacaaacccatatacagacatacacataactaaagattgatgggggatgtccttctgtatatatatttctcttattggttgatgaataaaacactgattggcaagtagccaggcagtctgtataggtggggctacaagatgaggagaactctggggagaggtcacagagagaggttgcaagagagtctccatggagctgaggaaggagttaacaggtctggacccttctccggtaagaaaagaccatgtggaaatacttagattaatagaaatgggttaataattaagaaagagctagccaataagaagcctgagccattggccagtttataattattataagcctctgtgtgtttatttggggttcaaagagtctgtgggaacaagtgggacagaaactccatctacaaagctacagagaaaccctgtctcagaaaaaaaaaaattttaagaatccaggcatagtggcatagcttgtaatccccacattcaaaagatgatagcaggagaatcgggagttcaaagccagcctgggctacttgaaactacaacaaataagcaacacataaaatgaaggtgtgaggggagatgtttcaattaccttctttgttagtattcttttgtttgtttttgagacagtctcactatgtaggccttggctgatctgaactatgtataccaggctttccctcaaactcatggacattcacttgcctttttacctcggagtgctgggattaaagatatgtaccactatgcccagctgctattattcttttaataagtgtgtgtgtgtgtgtgtgtgtgtgtgtgtgtgtgtgtgtctttatctgtatgtaccacagataaatgtgaggttgtctgtggaggccagaagaggacattggatccctggagctggagttataggcagttgtgaaccactgacctggagactggcaactaaacttgggtcctctaaaagagcaataaataagtactcttaaccactgagcagtcttgtagggagacaccctagccccgtccaatagtcctgggacaggtaccaggtggacccggtacaattccccttttaccctagccccacccaatagtcccgggtccacctggtacctgtcccaggactattgggcggggctagggtgtctacctacacagtctctcagatccctccctaccttcccttaccagatccaggctctcctagccaaggatgaccttgaattttgatcttcctgtctccacctctcatcaaatgtcaatcattcatccttctcagaataatgtatgtgctatgataaaatattatcatcctaaagatgagagagtatagattaggaacaaggctctgataaaattttgccatctgccaggcgttggtggtgcatgcctttaatcccagcactcaggaggcagaggcaggtggatctctgtgagttcgagaccagcctggtctacaagagctagttccaggataggctccaaagccacagagaaaccctgtctcagaaaaaaaaaaattgccatctatagaactaaggttttgaacagtaatccaggtacagtggtatgtgtctttaattccagcacttgggagcaagaggcagacagatttctgtgagttcaatgccaatctggtctaaatataaaattccaggatagccagagtaaaacaaaaagaccctgtctcaaaatgaacaaacaaattaagagcttcaaatagcagaaactaaagaagccttagcatcaactgcaatgttatccacctgggtataagcagtcccaggtgcatgctcccactgccataaactcagccatatcttcctgccatatttttactttataccgtcaaaccataagtttaaaataaatcctataaatacaataaaatgtgacgtttcaattaatgcccattattttaaatcacgtcactggctataaccatcaaaacaataagatgtctgaagtggaaagtctctctcatatctataacatgtatgatcctatttgttgactgtgttgttaaatatgattgataggagctgggggatatatctcactggaggaatgctgcctggaagaccagaggccctgggaatatgacttttttttttctttttattaggtctattcatttttaatgtgtattttgactgtatgtggctatgtgtgccacttgcatgcctggtgcccccagaggtcagaagagggtgttgaatcccctggaactagagtttctggagtttcaggtggttgtaaaccattatgtgggtgcttggaatcaaactcaatcctccagaagaggagtaactgctgaaccatctctccattccaatttcttattcttattcttttttgagacaggatctcattttgtagttctagcttacctggacctccctatatagaccagactggccttgaactcacaaaggtcttcctgcctctgcatcctgagtgctgctgtgattaaagtagacctgaccttgattatattactcatgtaactgcttgatatacttttttttaaaaaagagatttatttatttgttatgtataaagtgttatgcctgcagcatatattcctgcagatcagaagagggcaccagatctcattatagatgtttgtgatccaccatgtggttactgggaattgaactcaagacctctggaagagcagcaagtgctcttaacctcagagccatctccccagccctgcttgatatacttttaaccttttaaggattaacattctagactgagaaacaaaacactatgcacaatgaaataaaatgtatcaataccagttgtagatgagcctaaaatatgaagaaaaataaaactgcatgggagttgaggtcttgaaccacaaacatggcaaaggtgagggtctagggcaataatagctcaatggttaagagtgggttaaaggaggaccagggtactatacacatacgtagtgcacagacatgcaggcaaggtactatacacaaacatacaggccagcaaacacccattcacatgagataaaaataagtctttgaaagtgtcaaaggtcacccaaggtcccaaagcctctctacttctgtggcgtcttggagacccctgtggggaaacttggcaggatttgagtctgggactgagctcagcagctttgctagccatggcactgtgtatcagcccccaccatctctcagttcccattctgggcaagaagccaaaaatacattcttcaggcccccacaggcgtttggagctgacagagtggagcttgaggaaagggctgagcaaagcagaaacctcctgagagtgtcaaaaggcagataacaaataaccacatcacggggcttatgcaacaatggagaaactgagacccagaaaaagtgagtgtctccaagaccacacatgaacaggttgtggagagagccacccaattaaggttctcctcaaagcacttctctggtcctcactggatgtgacgagtcactacatatctcaggatttgagggccacagatgataaaagaacctgaagttaaatgctccatcagccctttagcaaagaatctagttgtcctttcccagtccccattcttccctttcccttagcttcccaataggtgacaaatcctagtcacaacccagagagcccggagttatgtccccattttaagatgaaatcaaggttcttggaaatgaagtgatttgtccaagaccacactactagtgaatgagagacaagaaatacaaaccagtgctacttagctctgtgcttctccccccagggtgaccccaggtaggtgctgattctattttcatgcccacatcccatccctcaagaccaggctggagccacttggtgcctggggtaagcaggaaagaaattacaacagcccttcccagccctccggctctgttccctggtacttaccctccagcaccacctccttgcctgtcttcttgagggcctgtacggcttcatcatgggtggcagaggacaaatcttcaccattcacagacaggatggcatccccaacaaagagtgcctccgtctggtctgctgccagtcccttgaagatcttggaaatgagaataggcatcttgttttcccggccccctgcacaggcacagaaggaaggggaaactgaggcgtgtgcttcaaaatgggaaacttaccaaggtgaaattgattctgactcagtgctgggaaagggaaaatgagcaaatagtgagaaataaagggaggaaacttaggagtttgaccacagccagacttggtgacatgcagccacaattccaacatttaggaggctgaggcaggaatggagtgccttgagtgcagagtcactcagagatatagcaagacagacaaataatatattttctaaatccataatgctatattttggttcctagatcttctgtttaaatgttttgtttgttcaccacttcactgattttttaaatgttttggattttaagcaattttctacagtatgaaaatttactgataacccccatctagagtcaagggaaaagtagtggttgctatggcctgaagggacctcttctacaatcagcaagttttagaatccagagctgggtgtggtacacaaagcctgctatcccagcacttgggaagttaatgtggggaagggggtggggaaggccagaagttcagatcaacctcagctatgaagggagtttgaggccggcctgggatgtatacaaggccatctcaaaaataaatagttaaatgggctttactaaccaggattcacactggaaaggaaggccttaagttctagaaatttcaaaagtatatctgaatttcatctctgatctaagaaaataatacatttcactgaactactttattgttaaaatctcaaatgtcattttaaataattcaacatgtatttattttgtgtcttatgcgtgtatacaaatacacatgtcctatatagtacaatgtgggagtcagaggacaacttgcaggacttggttctctccaggaccatttgggtcctggagatcaatctggtctgcagtcttgagagaagacatctttaccctctgagccagtggttctcaaccactggatcacaacccctttgagggtcaaacgactctttcacaggggtggaatcagatagtctttatatcacatctttacattatggttcataacagtagcaaaattacagttatcttttgggggggttcaagacagggtttctttgtagctttggagcctgtcctggaactcactctgtagaccaggctggtctctaactcacagagattgcttgcctctgcctcccaaatgctaggattaaaggtgtgagccaccaccaccaccaggccaaaatgacagttatgaaatagcaacaaaaataattttaaggttgggggtcatcacaacatgaagaattatgttaaaaggtcaaagcattaggaaggttgaaaaccactgcttctgagtcatctcatcagcctcaaatgtcttttgcttgttttgtttgtggttttgtttgtttgagaaaggatcttactatgcagccccgactggcctggaactcactatgtctaacaggctagtctgaaacttggagagatctacctgcctctgcctctggagtgctaagattaaaggtatgcatcaccacacccagaccaaatgtctctttaaatagttagcggggctgggtatggtggtacatacttgtaatcgaagcaccgaggtgacaatgaataaaggattactgcaaattcaagaccaacttgttccacatatgaagtttcaggacagtataacagtctccaaaaaagaaaaatcaatgtcgactctatatagactcaagtcagaccctcagatatcacgttcctgatccaccctcaaagtactgaagaagagagactggtggcacagagcaagaggtcattgtttcaaggttatataaattggtgacatctgagcctggaacacctcactcccaacccccacccaggccaacagttgctcatggcactgcaaaaggcttgaggcctaggagaggaaggtgtttctatttatatccagcctctccacctaaatgtaaggccttccattccatttgaagctatgaccattcccagctgcctgggactcagctggaccccagaagggaagttaccatggcaacaggagcccagtcttcaatccaggaggaagtgaatgaaattccctaaagtcccaccaaaatatcctttcaatcacctggaagtacagatttgggtagtgtctctgtaccttggtaagaccctgctcctcgaagagttagtctgtctgtctgctctgacacaccaagtgtatttttttattgctgtttccctagcctataccagagtttgggattaaagctggtgcccactccctgttctcccgtttctcctttagactcttggggttcactacctgggaatttaccccttcctgggaagaactgactccctgggcagtctttagggcaataaaggctctataattaagattgaagtcctggttctgctgtacacagactgatcctgggaaagtcacttttcccttttgagtccttttagcactgatgctcaaaatgaagtagaccctgaactaagcataatgaacacagcgcctagcacacagtggcattcaccaccatgcccacttcctaacctgggccaaagtctagacaaggtatcaatgaatacagtcagctcccaggaggcctgggaatgtaccgacacattcagttttttaaaaaaggctggcagtctgttgagggctgaaactggtagacaaggcaagaatggtgaacccagaagttgaggatacacatggattttaagcaccagaagctgggggtgcacatggattttaaacaccagaagtcaggcccggtgttggtggtgcatgcctttaatcccagcacttgggaggcagaggcaggcggatctctgtgagttcgaggccagcctggtctccagagcgagtgccaggataggctccaaagctacacagagaaaccctgtctcgaaaaaccaaaaaaaaaaaaaacaaaaaaaaaaaaaacaccagaagtcagggatacacatggattttaagcaccagaagctggtgtgcccatggattttaagcaccacattcagctgatttgagagtccctcctggcctctcttcctctcatcacatgttggcaagccctgctctcagaaacatcctcatcatatagttaccaaaacagattcagagatagggagtgacttgaccaagttcacacagagatccagaactccggttgcagcctaagtgacctggggaagcagtcagttggtaaagtgcttgtctaacatgtataaagctctaggcttgatccccagcacaacataaacctattttagcctcacattccagtaatcccagcactctgggattacttcggtgttatcctttgctacgtagtgactatgaggccagcctgggatacaccagaccctgtcaaacagtcgttagtcttagaggcgaagaactctcaagaaggaatggcagctctggctcaccctttccccctgtccatggtacaaatggacagatgaggagactcaaacctagtcatcgagactcccagtctaggcatacaaccttctggagcccaagatatctaggttcttactggccaggccttcacctgtgcacttaggttgtgtctcagaacttcccccttcttgtcctagtagtgtcccttttcgccccgtcgtctgccttcctgaggatcctcatgcccttgatacctatagctaccattttgcttcaacacagaactacgaacccatgtccttggtgcgcccgcacacttccacacttgtgtctgctgagctccctgtaagatctccaactccccaagccccttccgaccttggtgttcctccttcctcactcctgttccttcctcccctcaagctctgctccagctcagacagcaggcttttggctatctagtctccttgctctgccaggccccgtgacccctgggcacttcgcagcagcatagacaccacgaccccatgccctcagtgccccccacctacccttgatgctgatgcccagcccgccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggtgccaaagggggcggggcccgggagagactgaagagatgctgctgggtaacctaaggatgctctgcgggaccgcttggagtgggtcggagccgcgtcgcggcgaggccacaaagttagaggaggcggttgaggtgtggagtactcagcggggacataaagggaccagattctgtggatgaggcaacccaaggatcgggttctgtgtgccgtcgaggactggaccgtagctcgtggagcagaaggacaagaaaaagaatcaaagatccctgggcgagactttgggagtctggacaggactgcgtgtggcggggagctaggctccagggacttggcagacagagttaactggtaagcgagctaaggaaggagatggtttccctcgttttgtgtgccatggggagaggactgtgggcgtggttcagcttcagggcacagtgtctaaagaggtaggcctgcccaccaggaggagaaacgccactcctttgagggcttgatcccagcacttataggtagaggcaggaggatctacaagttcaaggccagcctaggctacatgagaacctgccttaaaaatatacaaaataaaaaatgcgtaaggagctgaagagatagaaggtccatcggctaagagcatgcactgctcttattgaggaccagaataaagttcacatcatccatgttgggcagcacacaaccacttgtaattccaactccatggagatctgacaccactagcctccttgagaacctgtattcacattgcacacacccatacacggcacacaaaaataataaaaataaataaaaagacgtgtgttacatacacacatacatacttgaatgccatttattcagtgtttgcatgacatatgagctggctagtttacactatcatttgtacctcatttgtaaattctgcatagcctatacactattaccattttattgataaggaaactgagacagaagtactaagagcagacctctgtgctttttgtttgctagtttttgcttgttttcttgagccaggatttctctgtgtagctcccctgcctctgcctcctgagtgctgggattaaaggcatgtaccaccatgcccagttgctgacctgtgttctaacttgggtctttctggcttccaagttcatatcccctactccccttagcagcaagggatggttgcactattcactaattgatcactaactggaccaaacaagatgccatacacctgtaatcacagcactctgaagactgaggcagaaggttcatgagctaattctaggccagctagggattcatagcaagttccaggttatacatttttaagtttattttaattctatgcagattggtctttttgcctgtgtggatgtctgtgtgccacatgaagtcctcaaaggccagaagagggcatcagatccctggcacaggaattatagaccattctaagctatcttgtgaattgaactccagacgtttttgttaaagactgaaggacaagccaggcctactgaggaaggtctgcgatctcagatactcaggaagctgaagcaggatagtcacaagttcaaggccagcctgggcaatttagtgagactcttaaatgtttaaaatacaggacttggggtatatagctcagtggtagagcctatcatgtataaagccctacagtaaatctcaccactgtaaacacacacataagggggtaaggattacaagtctcatgcttgtagtcacaatactagggagatggagtcaggaaaatcaaaagttcaaaggctagggtagaggagatggcccagcagttaggagcactggctgttcttgcaaaggacttggatttgatttacaacacccatgtggtggctcacaaacatctataactctagttccaaggcatcttacaccctcttctatcttcaatgagtataggggcatatacaggcaaaacactcacatacagaaaaaaaaaaaaaaacatgttttgggttttgcactcataaacataaaaaaacatgttttgggttttgttttgtttttttgtgagttttttggttgttgttttgttttggggggttgttttgttttttgagacagagtttctctgtagctttgaagattgtcctagaatttgatctgtataccaggctggcctcgaactcacaaaacatccacctgttgtcatgtcagggtggccgagtggtctaaggcaccagactcaagttcagcttcctcaagagatctccctgtctctgcttcctgagtgctgggattaaagacgtgtgccatcaccgctcagctaaaaaacatgttttaaagttaaaattctgcatagtgagaccctgactcaaaaagaaaatagagagggagggagaaaggagagatggggagagagagcatacaagagtacatgagagagggcacagacccacacatcaccaagaactgaggtcctttcccaagaccaaggctagaattagatccttaaaagtccccccacgtagtgccctgtttaaagaagcttaatgaagtccagccaaacttctgggaaggaaccctaatagagagctcctcccctaggaaatgttctgaggacagagcttaggaaaggggaaatgggcatctgtataccaagcagctagctgagaagggagaaagtgtagagccagaaaaggggagaggtgtccatgattgaacagcatgagcagtgccaatcaccggcttctctgccagctgcctcatgaacatgtagctggaggaatactctataccccctcacttagtcagctgtggccagaaattgatcacacacacacacacacacacacacacacacactggcctggctatctaccaaacgcctgggcaaagctcccagagaaaaccagttcacagaagagataggagggggaacctagaaaaggacgaacacaagggaactgcccagcatttacacacacaaaagaaataaataaaattgaaaagtagggtagttttgcttaaggtcaggtgaaatcaatcagccctggtaacatatgaaggatctgctccctaaatgccaagatttatgctaaaatgctaacattcctttacactaaattctaaaatctacatttcagatactctagcatctgagatgtctgaatctagccaatatcctagagtagcccaggaaaaaggttaaaggctttggatccaggaatctgctgatttagctaggctcaataactcatctctataatcacagcactcagacggctgaacaagagtatcagtgcaggtttgaagccagcctaggttacatagtaaggtttgtttttgttttttgagacaggttttctgtgtgtagccctggctgtcctagaattcactatgtagaccaggctggcctcaaaatcagagattcacctgcctcccaagtgctgggattaaaggtgtatgccactatgccccacaagtaaatcttgtcttaaaaacacataggcccagccatgcagtggtggtgcacacctttaatcccaacacttgggaggcagagacagctggatctctgtgagtttgaggccagcctggtctacagagcgagttccattgagttccaagacaggctccaaagctacagagaaaacttgtcttgaaaaaacaaaaagaaacaaaaaacaaaaaaccctaataggccaggcagtgatggtgcatgcttttaatctcagtgccccagaggcagaagcaggagagctctgtgagttcgagaggccagcctggtctgcagagtgagttccatgacagtcaagactacacagagaaaccctatctaaaaaaccaaaaacaaaacaaaaaacaaaaaacaaaaaaaacagaaagtgggcaggcaagattgctcactggggccaagcagtaatggctcatgcttttttttttttttttttttttttggttttttgggttttttttgtttggtttttttgagacagggtttggagcctgtcctggaacttgctctgtaggctaggctggtatctgaatcacagagatccgcctgcctctgcctcccaagtgctgggattaaaagcgtgcgccaccaatgcccagcttttatttttttttaataaaaacaatctcacagcatttattgtcacctgataataacataagggccactaaaacaatatgaataaatgtttcagactgtgctccaagcagaagaaacctttaaaaacattgtacttcctcttcagcttctcgagtgcctgagtttatagtcggaaacactttggagcagagtaatattgtctcctttcagcatgatccaatccagttgcttccttgactttgttttagagtggatctctctgtatcatctaatatgaggttcatatactcatcaaagccagtaaaacaaccctctatccacatattcgcttgctcatatagccacacctgaatccgagacctaatttgcaaatatttgaagatgagtttgatgggctgcaccgtctgaccctggccgcagtatgccatagtggaagtcacaaagaccacacgagtaggctgcctcagaaagcgacttccagaagtaagaccaggaaaaaccgtgtctcctgcagttaataccagaatcttggaggcagatttctgagttcgaggctagccttatctacagagcaagatccaggacagccagggcaacgaagagaaaccctgttgttgaaaacaaacaacaaaaaagattgttcaatggttggaaagacttttgtataggcctgatgacctgaattcaatcgtccacaaggtggcagaagagaacctacttctggaactcacacgaatacctgcgcacaataaattgtttttaagtttaaaaaaaaaaaaaaaaaagctggcaagctgtgtaaagaaacttgttatacaatcttggtgtcctgagttccattccccagcacccacataatggtggaaagagagaacttcacagaattgtcttctgatctgcacacatgtgtcatggtacatactcccatacccacatatgcatatcatgtatacatgctcacacgcgagagcacacacacacacacacacacacacacacacacacacacacacccacaaggaagagaaaaagacaagacagaaacaactttaagtggggctggagagatgacccaaagttaagaacactggttactcttccagaggacccaggtccccagaattcacatagcagctaacaaccatccggttccagggaatctgacaccctattctggcttctgtaggcaccaggaattcatgtggcacacagacattctgaaggcaaaaactccctgcaaataaaaatgaataaatcttgccgggcgttggtggcacacacctttaatcccagcactggggaggcaggggcaggcagatctctgtgagttcgaggccagcctggtctccagagcgagtgccaggctaggctccaaagctacacagagaaaccctgtctcaaaaaaaaaacaaaaaaagaataaatcttttattgtaaaaataaaaggaaccgggcagtgatggtgaaagcctttaatcccagcattcaggaggcacagacaggtggatctctgtgattttgaagccagccttcaaagcaagttccaggaaagccaggactgttccacagagaaaccctgtctcgaagaaagagaagaagaagaagaagaagaagaagaagaagaagaagaagaagaagaagaagaagaagagagatcaggtgttatgacatgtgcttttattcctgttaaatttcaaatggctttggccagtacaaatggctgaggtgcccacttaacatatcaaaacgaacctggccaagctcaatctagtcatgtccactccgcactctcccagatgtccctgtctctacctctgctctcccatatatctataataaactttttcctccactgtacctcagagcagtcatggcctttcctttcctttttatttatttattttttttcattcaattccaagaactcttgaatcagaggtcagcctgtctacatagtgaaacccaggctagccaggacctcaaggtaaaacactatctcaacaacaacaataaaacaaggcatggtggtacatgcttttaatcctagcacttgggaaatgggggcaggcagatctctaagttttgaggttagcctggtctagaaatcaagccagggatatacagaaaaaccctggggggcggggagtaagacaaggggttgggggtaggggagaaaccaaaatatccgacaggtcctccctgtgttctgatctggaattccagcctgtgcaaggtaagtgaacagttgttcaaagagcaagtgaagacaagaaagcagcagatcaggctaatgagatctttggaatgattctaaagctaaaatgacaaatgatagaatcgcaatgcagttggaagactattcacacaagccaataaaggagaatggataaaatgcagacctgacatttcctaccaagtgttctctcctttttcttctcaattttgtttttgttttgaaatggggtttctctgtatagccctggctgtcctggaactcactctgtagtgtaggcaagcactcatatacataaaaataaaagtctcaaaaaaaatttagtgcttctgcctggtgtgataacatacacctttatttccaggaaccagaggcagacacaggcaaatctctgccagtttgagacaccagtctacctatatgttgagttccagtccagccaaagctacatttaatgcagggggaaaatgcttctaatatatatgtgatattggtgaggccatccaagaaggtgtagaaccctgttaagtagaaataaatggaagacatgtcaagtgaatacaacctacaatctaaatagacattcgattgtgtgatatagaatacatgttgggcaggccagcgaaatggcttagtgggtaagggcaactgccatcaaacttgatgacctgaggttgatcctgaagacacacatggcagaaagaaagaacccacccttctgacttccgtggaggaaccatcacagaagagcacacacatacacagacacacagacacataaaaaaatataatgaagaagctgggtgttggtggaacacactttaatcccagcactcaggaggtagaggcaggtggatctctgtgaattcgaggccatcctggtctccagagcgaatgccaggacaggctccaaagctacacagagaaacggtatccatgtgagagaagggacaaaagagaaagcgagaggaatgaggaagaagtatatgacattaaaactcttagtagcacaagaaaaagcaggctcccttcatgatgatatggagcattcataatacataaaatattttattgttgggcatcagtcaataagccttctaagaacaaaacacttgttaatattaccagtaaatactctggcactcttgccttctactgcagatggttagattgacaggttcatgactctcaagaatctgactaggtctactatcctatgttccagactaatcagggtttcacatggagaccttgtctcaaaagggaaaaaaaagcagacaagccagtcatgtaagtttatatatgatataattttataagtttaattaatcgaagttagctcaaagtcacctcagcatctttattttctaaacattgtgggaaaacgtaccagaaggaatttgcaacactttatctgttttaacataatggactgtgcaatagttttatctaagtttaaaggtttcatcaaaggcaactgtctttggcacaggtagtactgggaagtgtcagtgatatttaagttggttttcacaatgctcaggtagtgaggaacaaaaccttttagagaatgaagcagacaaagcctgccagggtaaagaatccacgttttttatggagtcaatggaagccaggaaggtattcatgattcaggttctcttttttgtttgtttgtttgtttgtttgtttctttttcgagacaggatgattcaggttcttgatctgagcaatttcagttacagtgcaacacttcaaccagctctgcctgtcctgccagcccacaagcagtcactggggaaaggccctgtttagggatccagacagactaatgctgaattcagcccacacagatcctgcctccactctccatcccaaaataccagctgggcaccgcagcctgagtatcattttcctcaaccctttttctaattaaaacttttgtcttgggggtggagattccagcagggggcagcagactgccagggctgcggggtccaggcagggtcctagccaccatctagctcaactaagtaacaaatggaaaagaagtgggtttctccttcctccttttttctcttccacctcttccttgtctccccctcccccttttgtttctttcacacaggagctaccagcataacccgagttagcctcaagctgtaaatattccttccttaggctcccaagttttggaatcacagaccaaagacatcttacctgttctgtttggttgcttctttaaccttttttcttttttttctgagacagagtctgactgtgtacttctgactaacatggaactcactgtgtaggcaggctagcctggaactcacagaaatctacctgcctctgcctcccaagtgccagaattaaaggcatttggggggggggtgagagaggttgtgtatgctatgtctatgtgggtgccctcggaggccagaagggggtgtcagatctggagctggagttatgggtggttgtgagccacctgaatgggtgctgggaaccaaactcacatcttctgagagacacctgactcagattgtcactatttatctatttactctttcattaatttgctatttacttagtggccctgaagattgaatccagagccttgcacattttaggcaagggctatggaaataattactatttttgttgtttgattgggtttttgtttgttttattatttcttgcgagtgtatgaatgttttgcctgaatgtatatctgtttgccacatgtgtgcctggtgcctgtggaggtcagaagaggtcctcagatcccctagaacttgagttgcagatggttgtgagctattttgtaggttctgggaatcaaccttggtcctctgcaagggcagtaagtgctcttaactactgaaccatctctccagcccctagtctgttttttgaaacatggtttctttgtgtatccctggctttcttagaacttgctttatagagcaggctggcctggaaaccagagatctgctggtctctaactttctattaaaggcaaacactgctaccaccaaggtatttgtttttgagacacagtctcattctgtagccccatccaactatatcacccaacctcgtctcaaacttgttgcaatctccatgccttgactcttgggcactgaaattacagctcaggtctgctgaggttttgaagcactttcttctgttctccatgtgaggaaaccacatccgtctaatctatcaccctcctcattattattatcatcatcactctgtcaaccacacgtttttagacaatcctatccctatttcccctccagagcgtggactggagcggtaggaaaagaaccaataccgagagagcaagttgactaggactatagccctagctttccattgacatagtgtgtgacctcagtcagaacattcatcctcttatttccactttacacatctgtagaaagatgggaatatgaaaatgaaaggttgcctggcagtggtggcgcacgcctttaatcccagcactcaggaggcagaggcaggtggatctctgagttcaaggccagtctagtctacagagtgagttccaggacagccagggctacacaaagaaacaaaacaaaaacaaaaacaaaaaaagaaaattaaaggtgggcaaggcatggtgaaacctgcctttattcccagcttctggaaggcagagacaggtggatgtctataaataaaggccagtctaatctacatagcaagtccagtccagccagggctacataatgaggccttgtttcaaagggagtggggggggggcatggaggtctggaaagatgtctcagaggttaagagtgcatactgctctagcagagaacctacattcgttttcagctgccatactggatggttcacaaccacctgaactccagctccaagggaaatctcattcctccagcctccaaaggcacctacactcatatgcacataattacggggctggagagatggctctgtggtaaagagcactgactgctcttccagaggacctgggttcaattcccagcacccacatggcagctcacaactgtctataatttcagttccaggggacccaacgcccatggcaaagcaccaatgcacataaaataaaaattaaaaaattaaataaataaatctcaaaaaaataaagaaaaggtaggccagtgagtcagtgagtaaaagcacttgactccaaacctgaagttcaatctccagaacccatggtagaaagacagagctagcacccaagggctgtcttctgacctgcacctgcacactgtgaaacatggacatctctactcatgcatgaccatcaagcatatctacactgtaataataaataaaacttagataagaaaagaaagaaggaaggaaagaaagaaagagaggaggaaagaaagaaagaaggaaagaaagaaagggctagaggacactaggaagaattgagttgggtctgtgtaagtacctggcatatgaagaagcttccatacattttaattcctgctaagtgtactggttcacatctataatcccagcacttgagaggctggggcaagaggagtagcatgcactccaggttagcctggtctacataatgagttccagaacaatccaggctacagaatgagaacctatctcaaaaaaagttaaatgaaattgggcagtgaggtcactcactcagtgggtaaaacccctagcaacagcctgtgcactatcctcagaaacaccatgaaaggagagaatttgagcacggcggtggtggcatactcctttaattccagccctcggcaggcagaggcagacaggtctctgtaagttcgagactagcctggtgtacagggcaagcatttttctttttgttttgttttgttttttcgatagagggtttctctgtatagctttggagcctgtcctggacctcgctttgtagaccagggtagcctctaactcacagagatccactgcctttgcctcccaagtgctgggattaaaggcatgtgccaccacaagctggcttcagcaagcattttttaacacctttttaaaaaattattttttatttttatttctgtgcactggtgtcttgcctgcatgtatgtttgtgtgagggtgccagattctctggaactggagttacagacagttgtgggtgctgtgaattggacctgggtctcctggaagggcagccagtgctcataatcactgagccatctctcggccccattttgttccaacactcaggagacagagacgatggatctcggtgaatttgaggccagcttagtctacatacccagtttcaggctagccagagctacatggggagaccctgtctcagaaagagaggatgaagggagcaaaggactattctttggcttcagaattttcctttaacactggaatttactgctttgcaccagccaaagtcagggggttcccaaggcctggaaaaccctgcccctgtttccacgcacagttctccctttctgtggtcctccacccacccatgtgcttcatcgcgccacccttcatccagaacaactcgttttctttttctcacagatgttccacaggctctttttcctcagaaattccctcaaaagcattcactggtaatttttctaaaatcacagtaattacctcattactttgatattaatagacctcacttggcaccagggtgccaattgaaagcgctcaggccctgtgtgaggggtggagagggagcctgaagagcagccctcctgaatgctggccctgggacagcccttgtttgcctccatcccaagttgtccttcacctttgctcccaggtgttctgatttcaaaagagaatcctggatccacaggctcctgagaaatgttagctgcctgaccaggaaaaaggaagataaaaagaaatgatggaagctaaaccatggactcccccgaggcctcaagtctcacagaggaaaggcagatggtgagaggccaccctagaccacctttcccctttccttccctcagctacacctaaggctttagcctgaaggactctctccagttacacctcccccaggacctctactggcttccctacagctctgtaatccagtgtggtctctacatctcctggtcaataatttatttgatcctcactatattcttattattttttaataatatgtaggccttgtatttcaaaatgcatcttgaataaaatggggcaactgtattacggttaataactaatacgtagcccataatggtcaggatatatttttattagatagccaaccagcaggcagaacaagccaaaacagcagggaaaagagagctcccatgtgcgttccctatctctttaaacctttaccatgtcaacctgacatcaccttgaccacaccctggtgggtgtggtcgggcacacctgtagccagcccttaggaggcgtggttacggtgtctccctacataactgtcatcatttaaccattttagataaggaaagaacataagcttgtaactgaggactactcagggttctgggcctgcacctgacagctacagaagccctgggacttctctctcctcacctggagtctctagtagctctagtggatttaatctgcatgtattgagtgttccgtcaggttacctgggttatgctattgagatttgtcaggtgatttgttccagagtgcgctctcgatagctgatagctcagactgctaagcttatactcttcaccttgacactctcctgcgagcatctccctctcaaggtcatccagagcagtctctgagactgctgatacaggcttgctgaaagtcaggactgaccagtttgccacaacccctacctgattgactgtactacctgactcattgcatcggagtctgcaaaccggttgtgaccatatggctgaccacgctatgctggccacatttgtccatcctcaggttggtagatatgttttccaagtccaaggctctccagcacacttcctgggaagtttcctctgtaaacagaatgggaagagtgatagtctcaacagaaatccaggacagagagtgattgggcagccagactagactggagctagtgggtgggagaggggcagtatagaggatcctttgttaggccagaagctactaagctgccccatccccaccatctggctcctgctgcagcccagtgatgcatgatggggaatattgggggcgggtgctaggggctacccacctgctctgcctcctgggataagctgatccaagacctcccagacccatctggtcaacacatccccaggccctgaccacccctgggactcctttagacagactgaaattggccgggagtgtggccagcctgtcagggtcacaggtcaccgttaatctgccagaacaagggaggacaggcaggtgggcaggcaggcggtgtgggcgaggccatgggagttcctgctgtcttcctagtgaccacagagggagggtttccccttctgggaggcagggagaaggttattggactccagggaaattgctcattctcacacctagctgttctagttccagatgggaaccctggaaactctccttaaatatgcttagggcatcatggaaactatgcatgagacagagaaatactggggaaaatgtaagtgcccatcaacaggaactgggttaatctaaagactgagaccaacttcagtgttactgaacttcttgggctgagaactgaggtccctgtctcaattgtctctaggaatctcttgcctggaaagataagactataaaccaacagataacctcactgtttgtctcagagagttcctgcaaaccaatttctttgggcaaacagtttgttcaacttggccaaaatctctcttgtcagacaacagtttaacctcaatcttatatttttggttgtaagcctagcctttaattgctgaggtattccttcagcccttaacttcaatattttaggagcataaaaatgggcttatactcaggattccacctggcctcaggcttgcaacacccagcttctccttcccagtccagcctgcagtctgcagccccagcactaagctcttctccaagcttcttaccagtctgagcatgtgtggaaccctccattctgtggatcagtaagtagctcaacatcaaactagcttacatctgagtcacagtgtctcatgttatcatgaaaaccaacttcatcagggactcaggggtccctctgtacaattgtagtgtgctaggaggacacacaactgcacctgcctttctcatttcttccctggaaatagtggaagtttcctagatcattcctaggctatttgggagatgaaagaactctatcccccattggaaacaagatctatctatctttgtatctatctatctatctatctatctatctatctatctatctatctgggtttgtttgtttgtttgtttgtttgagacaacgtgtctctgttgtgatttaagaaaagcagaatgagagagaaagatgtcatgagacttgcttcaagcagaggggttttttattagggaaagggatcataaaaaaatggggaaaggggagggaggagactggcctcctgggatgggagcagcaggaaagaggaaatggggggagagagaaaaaagagagatgagggaaaggggggatgggaggtgggcaaggcccctttaaaagggaacatagtaaatatgcacagatgacgctcttagtggctgtagctaagggtttatcctgtcaaaaccccaaggacaggccagtagagatgcctgaatactaacagtctctacattgccctggctgtcctggaacctgccatgtaggtcagactggccttgaactcacagagacccacctgcctctgcctccaaagtgttgggattaaaggtgcgggacacacacgacaaaaagaaaatttatgattttttttaaagagacacttcttgatggacatgggtggtacactcctttaatcccagcacttgggaggcataggcaagcagatcttggtgagttcaaggccagcctggtctacaaagttccagggcagccaatgtaacacagagaaaacctgtctggggggggtccacttttcagatatttactagtcccaaactgttatatcacaaattttgcccaatcccaatctgttttctgccttaagaggagctggactggtggttcatgagttaagatgtactgctcttgtaaaggacccgggttctagtaccaacagcacatgttggatcaaaactataactagttccaggggatccaacaccttcccctggcttaaatgggcaccagacacacatagtacacaagcatacattcagacaaacactcataaacaaaaacgtaagggggaaaatggtggtacacacctgcaatcctatcctttgagaggtagaggcaagagaatcaggaatttatggctaacctcaactaacataatgaattcatgggactcatctcatgaaaagaaaaaaaaatgagacgggtaaagtggtttacatttgtaattctagcactgaaacagtaggattgctgagatgagagttagggagggttacacaagatcctgttttaaaacaacaaaactcactggatcctctttctttgtgagtattcttctttggagccttctgaggcacttctgagactccctcaagaacctgcactctggtcagggctcagcagtttacccctgatccaacttggtgtatcactgagctacaccatccctcattctattttaaattaatctattgagacacagactctcgtagcataaactttgatctcagtatgtagtcaaggatgaacttgaatttctgatctttcttgccttatctctgagtaattagttacaggtgtgtaccaccatactcaagtgggcttattttattgtgatttcgaaaaatttgtgtgtgtgtgagagagagagagagagagagagaaagaaagtgtgtgtgtgtgagagagagagtgtgtgtgtatatgtgtgtgtgagagtgtgtgtatgtgtgtgtgtgtgtgtgaaagagtgtgtgtgagagtgtgtgtgtgtgtgtgtgtgtcagagagagaggagggggagagagagagagagagagagagagagagagagtgtgtgtatgtgtgtgcagttgcccagagaggccagaagagggtgtcagattatctggagctggagttgcaagcagttgtgagctgcccgatacagggctgagaaccaaagtggaagagcaacagctgaaccatctctctatagtgtccaggctgctttgctgagacaggctctcatgtagttcaggctggccttgaacttctaatcttgatgttttctaggtaagttttctggttgattagaattccaagacttcaaagttttctcagttaaaatttcacaactagatgctgcctgcctttcatcccagcacttgaagtcaggagagttcgaggccagactggtctactaagcgagttccaggacagcctccaaaactacagagaaaccctgtctcaaaaccaacccccgcaaaacaaaatttttacaactaaagaagctcttgattagaattttatggcactggagaaattgtgattaacattctatcaccagacctttttttttttcccttttcctttttttccaagacagggtttctctgtatctcaacagccctagctgtccttgaacttgctctgtgttctgttgaccaggctggcctcaaactcacagagatctgcctgcctctgtctcctgcatgctgggatcaaaggtgtgcacttgctcggcccatcaccagacttttattactgaaaatttcatgacttgagagctctactgttttgaatgtagtggtatcttagtgcttcagcagtgcaggcttctccgccaagatggcttggatctctgtgctctatcactttccttggaaggcctttcctgagctatttctgtctacctgccatctgctttaattttctccatgctgttgataaacacttaaaaaaaaatagcacctggctattctactacaatgcaagaagctccattagggcagaaacttattttggaatttcttttgttttttgagactgtctcatataactcagtaggatgacgtttgtttaattgttcatcctgcctctctctactttatgttccaccatgtccagtttatttggtgctgggaatagaacccagagctacctggaagttcctcatctttccagatttccaattttaccattactttctccagaaagctctcctgagtggccagatttatttgcctccattgtcaaaaatagtttaagttcttgtactgttattcataaaactctgtactattctatctatttaaaatagatacagctgggtggtggtggcacaggcctttagtcctagcacttaggaggcagaggcagtcggatctctgtgagtttgataacagcctggtctacagagctagttccaggtcagtcagagaaatcctgtctcaaaaaccacctccccgcccccccaaaagatagatgctatctgatagtctgtgtccctgccccaatctctttttgtgacagggtctcactatgtaaccctggctaaactggaactaaatatgtagaccaggctggcctcaaactcctgtctttgcctcctgagtgttgagacgaaaggcaccaccactaactagcaactggctgattctttgatacttgcagaaagaccatttactttatatctcctgcctagaccagtgcttggcacccagtagcaaaataccatattacactcctgcaatcagaacgaaaaaagaccctctagggctaaatgccatcaagaatcagaggatgcaagaaggaaccaagactttggttcacaagctcccttctgaagaaggcagctatataagggtgaacaaactactttttgttttaaaaaatatttattcttttacatatatgaatgtttgctacatgcatgtgtgtgtactattgtgagcctcgtacccatggaggtcagaaggcactggattccctggaactggaattacagaaggttatgagctgccatgtgggtgctagaaatcgaacccaggtcctctgtaagagcagcaatggctctcactccttaaacttattattgttttgttgttgctgttttgagacagggtctcactatgtaactggctatcctggagctaactatgtagaccaggctagcctcgaactcacagagatctgcctgccattgtaatgtaactgtaatttcttaactatgatataacaaagtcactcatcatgaagggcctccaggtccacttcaatttctttttcttccttctccttcttctttctttcttttcttcttcttcttcttcttcttcttcttcttcttcttcttcttctcttctttctccccccaccccagtccaaacaaggtttctctgtgtagctctgtctgtcctgggaccagaagggcctcaaactcacagagatctgcctgcttctgcctcccaaatgctagtgctgggattagaggcgtgcatcaccactacctagctaaaactttttcattttttaaaagattcatttatttattgtgcatagagtgttctgccagcatgtatgagggcatcagatctcattatagatggttgtgaaccaccatgtgggtgctgggaattgaactcagggcctctggaagagcaaccagtgctcttaacctctgagccatctctccagcccctaaaactactttttcttttcttctttttttctttggtctttggagacagggtttctctgtagctttgtagaccaggctggccctgaactcacagagatccccctgcctctgcctcaccagtgctgggattaaaggcatgcgccaccactgccttaaaacttttttgttaacacattaaaaaacaaggtgtgcgctgggaagtggtggcacatgcctttagtcccagcactcaggaggcagagacaggtggatctctgtgagtttgagaccaccctggtttacaagagctagttccaggacagcctccaaagccacagagaaaccctgttttgaagcaacaacaacaaaaataagctgtgccagccatgtggtttgtggccccctctgtatcacaactggcaggtgtacatgtgagccacagacagtacctggaacttgttcaagtaaacttcttatactggtttgacttttacttaactctcccagggacaaaaagatctggggactctgcaatgcagataaagctttaggaaatgtgagggtctcagatggacaagaaacacttttttctcccccacttcagtggtgctgggaagtcccttaactgttcagagcctggggctcctcctttgcaaacgggctacaataaaagatcttggctcccaaagcgatcatgaggattaactgagacaagccttcaactccaaccaggggggctctgcattacacaccggattgctattgttgataatgattattattactatgaccagcgggactttgggagtagcaaatggaaggaccatatgcaaatcctccagcgcaatgtctgttacactggagaccttcacaaaggctcataactgcctgttttacaccctcatcacccccacatcccaggtcatttcacataggctttcccagcatcctttatgctcccccccccccgcccccaatcccattgcaagatctcgccacacaagcctcagcagagaccagagaaagtgcccacggcagctggccagggtccgggagaggacccggcgccaagggaggcaggttccgggcagacccctgtccattgtctcaacccgccagcccgccagccagctgatgtcttgggtcgccgacaccagctggttaggccccacaccacctctgaaaggcctcctcctccctggaccctccctgtctctcatcttgcccagtagcccagagagaatcctagtgtgattacagggcctgggcttttgtccctcaaatcagtgactgatttgcattctttggcaatttgcatagcccattcttttgtggagggctaggctgatgtagagcccgcccagtcctttgcgtttgtttattccggtaattctatttttgtagccctggctgctttggaactcactatgcaactcctgcctctgcctccagttatctgtgttaacagggcgtgctgtccaatactgagccactaggcaacttggccattaaaatttaagtaattttagtactttggtgcctcagttataggcatcaaacacatatataggactttttttttgggggggggggtcagggtcttaatataatccaggctggctttgacctttgctatgcagtcaaggctgactttgaactcctgaccctccttcctcttctactacttgggagtgatgagattacaggctttcaccacagtacctggttttatggcatactggagacagccagagcttgaagcaagcattgtaccaagtgagctctatctctggcctggcagccacatattaaatgctcaggaggggctgggagtgtagctgtgttgaagcatttgaatacatctataggccctgaattccactgtcactgccacacacacaaaaagagagactgctgggcatggcaggacacatctgcaatctcagccctcgggaggcaagaggatggtcacatgtcgagaccagagtgttatgcatagttccaggccatccaggactaaatagtgaggcccatctaaaaataaagaaaccaaacctatagggactctcaaactaagcagtgtgggtataaatcatccatctctgaaagttctgctggatgaggctgattcaaaccctttaatctgactcatttctctttctagtcgagaggtcttccttctacagctcctctccctacccccaacaaggtaatgaccttggtgagtaggtgttcttttgttctccgaagcgcaggcttgcacctggacagagggtggagaacaggtgtggagttgtgccctggagcaccaatggggtgggctcaattgttgttcttacaaagcaaacaactgcactcagctctgtctttggcctcagctggagcctccattgcctggaggtgaattagggaggaaaggcttagggaactgtgaaccctgtccccaccaccactcaccggcactttaaggtcactcctccccctggatgagtggtttccagcacagctgacacctggggaaggtgtgccagatggaatgcgctctgaggagcggggatgggggaggactggcaatctgccaatggctaaggcccagctgcagcacaagctgtggaaggcatgtgcaggtcttctctagcctatttcaggttataggtatcccacatgcactgtggcgccacctcacttctggagaggagcaagggtttagcaaccacaacagtaacatctttcatagccatgtggccatctcttgccatcccaaagtgtatacccacgcctaaactctgcttctgctagtcctctagctagtcccatctcagcagacggctactccgtgcttccagatattccaggcttcaaatcttttattttgttttgtttgagacggggtctcactatagttttggctggcctcaaacacactgtacctctcctgcctcgtgagaggtgagccactatacccagttactattctggtgtaccacatataaatccttggcaaattctgctgcctctaccttcaaaatatatctaaaatccactcccttttcaaatctccactgccgccatcctgctttgagcattactgtagcaacattccacctttgccttctccagtatacttctctcccatagaggtcaagatctcaaaactatctggtggctgcaacaatgacttagaataaaaccaaagtccttactagggtgcaataagtcccacataatctatagtccccttctaagtctctggccctttaccaatttccattgtgttctatgaatgttcctgcctcagggcctttatttccttctactctctccaaatttggcatctctgttaccttcttcaggtttcagtggtataaatgtcacctccttagaaaagtcttagcctggtagtggtggcacacacctttaatcccagcactcaggaggcagaggcaggtggatctctgtgagtttgagaccagcctggtccacagagtgagttccaggacagtcaggggtacaaagaaaaacgttgtctagaaaaacaaaaagactttctttgctatctttatataaaatcatacctgaaacacaacctttgcctccctcccacctgctcttcagacgagtgctgttactttttgtggtttcaaggattgagcacgagttccttatgacccctaggcaagctttctaaccctagactatttctgcaggctctaatttgcctagtagtctaggttttctttagttctcctgattattggcaaatacagaattttccaatctttattattaattattattattattatctggttggttttttgtttgttttgagacagggtctctctacataaccctggcagtattagaactcattgtgttgaccaggctgcccttaaactgacagagatctgcctgcctctgcctaacaagtgatggacttaatttaaagacaaggacaaccaatcctggtccaatcttaattattgacgataattttcagatcttatactacacccgaggattagattacagaatgaccaacaatgggtttaagaggccacagggttcagaggtgctttactgacagtagaaggcagggagcagatagatgctaggagagttatggtatgtgcttagattaatattacaactaatgggggctggagagaggcttcagtggttaagagcactggctgctcttccagaggacctgagttcaattcccagcaaccacatggtggctcacaaccatctgtaatgagatctggggcccacttctggcctgcaaggaatacatagatgcagaacactgtatacataataataaagaaataaaaaaaattataacaactgatattgccacagttccagcatgggctgttgaagatctgggtgcttccagatgctaaattgagtgggttgggggagtgtttcacatctgtaattccagtatttgagagacagagccaaatgcatcaaattctaggccagcctgctggattatatagttactacctggccagacacaactggtagattctgtcttaaagaaaaataatgagatggtgtggtggtaaagtggtagtgggggtggagagtgagttctaggcttactaggtttccagaaaagataacttgagctggctttgtccagcagtccatgtaagctaatacccttggggctctggggacagtcaggaacttgcttgtggatagttcgatgatgggtgaagtcttagtcaatgttaggacccctcctattgtatgatccaggtgaaggagttgttcattctttggtctggtgtggttgataactttgtgggcctggtttctctgatatagttcccatatatctatgtgtacaaatgtttctgattaaatttgataaagcctatcaaattaagtggtagatagagcaaggacatcctgatctatttcttcccttccttccttccttccttccttccttccttccttccttccttctttctttctttctttctttctttctttctttctttctgtttttcgagacagggtttttctacagctttggagcctgtcctggaactctctctgtttaccaggctggtctggaactcacagagatcctcctgtctctgactcccaagtgttgggattaaaggcatgcaccaccacttctcagcatgatctctattttacatgtggtattgcaactttgcaataccagcactcaagaggctaaggcataaggattaaaaacttaagcctagggctggagagttggctttgtggttaagagcactaactgttcttccagaggacctgggttcaattctcagcacccacatggtggctcacaactgtctcacaactccagttctaggggaccaaaacatcaatgcacataaaataaaaataagtgaattatttaaaaagtcgagtttagtcaggcagtggtggtatatgcctttaatctcagcactcaggaggcagaggcaggcagacctctgtgagttgagaccagcctggtctacaagagctagttccaggacagcctcctaagccacagagaaaccctgtcttgaaaaaccaaaaaaggaaagaaagaaaaaaaaaagtagagtttaagcctagactgaactatgaaatgagactgaagtcagcagcagctatataatgaaactgtctcaagatgaaaacagaaaaaattggggaggcgaggattttgaaacagggtttctttgtggctttggaggctgtcctgggactagctcttgtagaccaggctggtcttgaactcacagagatctacctatgtctgcctcccaagtgctggaactaaaggcatgcaccaccactgcctggctatagtcttaaccattgagccttctctttattcccaagatcaaaaatttaaaaaaaattttttaagtgcttcattttcttcataatcttgttgagtttttgtcttaatttggttttaattttgcttatttgtttattttgaaacagaaacttatgttccttcatcatttctcatactgactcagaattcctgatcctcctggcttctatcgccaccaccagacagaacataatgttctttttgttttgttttgttttgtttttttgaaacagggtttctctgtgtagctttggagcctatcctggcactcgctctggagatcaagctggccttgaacccacagagatctgcctgcctctgcctcccgagtgctgggaataaaggcatgcgccaccaacacccggccataatgttcttgtataataaattttcatcagaagcatgctcattcctgtcaaaattgtaaataataatgaattctaaaaatacaactaatgtccaagaacctcaactgttcgtatcttctcctgggacgtcttaggctccttctctttgtttttttttttctctttcccagccatggtttctctgtaaaagtcctggctgtcctggaacttgccttgtagttcatgttggccttgaactcacagagatctgtaatgagggagggatctctgtgattaagtatggtttattgaacaggtgcaaaatataaaatacactcacaatacataacaagaatcctctcattccaaagagtgatggggaagtccccaaaccattgctgccagcgagacggccacagtccaagagagcatccatcgccccaccctggccttttattctgggtcacacccccccagagaagaccacactcattgggccaagccaccccaatacaattggctgttggatcaaattcccacaccagatctgcctgcttctgcctactgagtgctgcgattaaaggtatgtgccactttaccaccaggctgctccttttctttgggagaaaggttttgtttatctaaagagtcacactcatggcaagtatttctcaattacagagataggtttttgtcaagggtgaaggagttgagtacagtggaacacacctgtaatatttcaggggactgaaatgggaggaatggtgtgaattccagaccatgggtcacatggcaagtagtaagccagccagagtttgatatatgtttattatcaaacataataatgataataacaaaaatctgggcctgatggtatttctataatctcagcactataatagagccaagaggatcaggagttcaaagtcattctctttctaggctacacagtgagtgaattctaggccagtcttaggtataggagatcctgtctcaaatccagtcaacgagccaatcaactaccactaccaccatcataaataaataaatacataagtaaataaagtgccattggtgtttcaacaaggaatattacttataagaagttacacaacatgtctttaaatggcttctctcactgtcagctggtctggccttgggattatcattcattagaggaagtggcatggtttgggcagatggcaggcagcatgtatttctctctgcctgcccatctttactcttcttgtcaccaaagacaaatattgggggggaacaaaaggaagaagaaaaaattcagcttgccacgatcatatttggaatcccagaatttggggagctgaggcaagggatttgttaaaagttgcaggccaggctgggtggtggtgtcacatgcgtttaatcccaggacttgggagacagagacaggtggatctcggtgagttcgaggtcagactgttctgcctagttctaggacaggctacacactcaagcgttttccatttcctttgttttatctgaacctgtaactttctgtttgttttttgagacagaatttctctgtgtagccctggaacttgctctgtagaccaggctggccttaaactcagagatctgcctgcctctctgcctccctagtgctgggattggggtgtgtgtgtgtatgtgtgtgtgtgtgtgtgtgtgtgtgtatgtaccacttcacctggcaaatgccgctgcagctcaccccgatggcctctgacttattatcctgatgatcataaccttgaactgatcctcctgctttaatgctgagtgctggtgtacaggtgtgggccaccatggctgaccttgttttattgagactgggtcttactatgtggcccaggtactggtcttgaatcggcagttcttttgcttcagtttcctaagggttgggattacaggtgtgggctaccacaccaggctgcttcattttagttattttttaaaaatgttccttttaaattttcttttatgtgcactggtgttttgcctgcatgtatggctgtgtgagggtgtgggacccctggaactagaactatagacagttgtgagctgccatggggttgctggaaattgaaccgtggtccttggaaagaacagtcagtgctcttaaccagtgagccatagctccagccccctcatttagttagaattcctgaactataatttttgaaaaattatgagtaattcttcaaatataattttgagtctttgagaaacagaaaggctgtgtagcttaaagtaatcgtcctacagcccaactactttctttgttgctctgagcccccccccccccatttaagacaggctagtgactcatgtttataatcctacttcatgggaggctgaaggaggaggaatggtgagagttccagaccatcatggactacactgtgtgttctaggctagctagagatccaaaacagaccctttttttggaaacaaaacaatttgtgaggcctgctggtgttttaaacacaacctttgggagacagaggcaggagtatggcttaaggttcaaggatagcctagtctaggtgagtgagttcaagccggccaaatgtacattaagatcttgtttcaacaaacaaaaacatgccaggcagtggtggtgcttgccttcgcttttaattctagcagtccagaggcaggggcagcagatcccttgagttggaggtcagcctggtctacagagggagttccagaagatggggctgcatagagaaaaaccaaaaacaaacaaaaatcagaacagaacctgcttatatacatgcccctttccccatgaacacacacaaaacccccacaaagctcttggtctaatgcagaaactaataatgacagctactagcttttttttgttgttttggttttttttttgttttttgagacacggtttctctgttttgctttggaggttgtctggcctctaactcacaaagatctgcctgcctttgcttctccagtgctgggattaaaggtatgcaccgccaaagcccggcttttttttttttttttttttttttttggtactagcttaaaaaaaaattaaattcctatagtctagaaagaggaaggaatctgtgagatagctcagctggcaaagatgcatgtcactaagcctgatgcatgaggtgaagtttgatctgctggacctacagggtggaaggagagcatgcccccaacttgtgctctgacattcacacgcactccttcgaatgtacgcgcccaagcacagacacgcacacataggcaataaatcaatgtgaaagcaaacaagtaagtaaaaggagtaagaacaatttaccacccaaaacaaccataaaggcattaaggcctgtacctccagctgccctcccccgtagccccgccccaggactccgccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcggccttggatcgcaggcctggcgggcgcactatggactggccgcgagagaagtattgttttgttttcgcggcatcggggctgaaagtccggtcccgggaaaccgtaggcacgccggatttggagcgacgtgtggtagatgttggaagacgcggggccggtgttccggaggggcctgttgagttcaggctctggggtcggaccgcctgggttcacgtctggctccccggcgtacaagctgtgtgaccttggctctccccgagtctcagttgctctgtctgaaaaatgggctgtgaggaacgttctctgaactgccctgtagttgggtttagtgagttcagcggaacgccctgcacacacagttgcacatcacaagtgtgaaagctcgctattgtaattgcggtttattaatcatgtgtgcacctcggaaaagtccgaaattgcgatctggttgtgtattttttatttattttttttaaagatgtctttgccaagtcccgctgggtgacccggttgtgttttcattcttacctccgtcttgccatttcatttatctgatgttctttctagaatcgtaagatctttgcaggagggtttgtatccttaataagaacaataaaaacttaattgtcattaaaatacagtaatagccaacattacttcagtaccaggcattttgcattcgattcatttaatatttattaaatcatctcttaagtacaaagtatcactccaggcccagaggatatggcaacaaagtagattctggatttgagtttgagagaggggactcatgtaaactcttttgtggatttttctgtttatgcagaatggcattctaaaaacaggtatttgaggcactttcaaggcaggtgcatctttgagtttgaggccaacctgatctacacagccagttcctggtcaaccaggtctatattgtgagaccctgtctcaaaacaaaataaaaagtaaataaaaactgaaaccaggtatttgagtatgtccattgtgcagaggataaaatgagaggtattgagaacgccatgctctgcctccagagggttgttcttcagcgcttaaaagggaggatttatacagctgctttcttggactcttattccacattggactgaagaaatgcaaggtagatttagccattactcccttttgtagtgctgtgctcttgctgctcttgatggtcttgtggaggccgaccaggtaaccctgaggtctgacaaggatttcgttatattaggaaagtggaaaaaccttttatatgtatttaaattcatttacttatagcagtattgaggattgaatttagggccttgtactctatgctgtacactgaagtgtatccccagcctttttcagattgggtcttactaagttgcccaggcaacttgtaattctgtctcagcttcccagtagctaagaatacaggcccgcgtcactaggtctacctgaccatgtcttacattttcagttaaagacaggtcccaaaaagttgagtatggcgaaagcctatatgtaattgcagcacgcaggaggttgaggcagaaagatgtgagtttgaggtcaacccaagctatgccctgagattgttctggaaaaacaacaaaagctaagactttttggtttgttttgtaactagttttctttgcataaggcagtctgtagtgtttagtatgcttgcttattgattgatagctggattgaactgaggacctatgtgcaaggcaggtgtccccccccccccccccagtgtttctctaagtagctctggctgtcttggaacttgctctattgaccaggctggcctggaaactgcctcccatacctggcttggcctcttaactcttaatcctgtctcaggtgcctgaatactagcattacaggtgggcactgtcataccctagtctacttttccttaagttcagactaataaattacactgaacttcgttggtttgagtactttctttcattaagatagactcttactatatccgtagcctaggccagtcctacctcctggcctgacttcctcagagctggggtgttacaggcatgtgcccttttcagtcagtgcttctgtgttgaccatttgctgttcagaagcttacctacagtttcttgtttttcttgagtgctgaaggaacacaggccctagtgtatgctgggcaagtgctctaactgctagtgcttttaactatattcctggggaaagaagagtagaaaagaactcaaccctgagtctgctttcctaaactggaaatttctacatttccctggggaaatactgtagcactttatcttctggtgttcattccattaggatatatggctgagtttgcacacaatgcatgaatatttgttttgttttacacgttttttgtctgtcagtactggtcaaaaatcaaccaccacaaccagggcctcccattccctatgcaagtgttttaccattgagcttcattcaaaccctgaatattttgtgttattgaaaatcctgttgccctcaaacttgtaacactttctgcttcagccttttaaatgagggattctagatgtgagtctggctgaatatttgttttaaattttggtttaggctagggctgtaactcagtggtagtgtactcacccaccatgggcaaggccctgggtttgctcgattgctcataaataagtaacaattatagtcagactgaaaattgccattttaaggaataatgagctaaaatgtaagtggacatgacagtattgtctctccaaaccttggtgtgatagtcactagtcttgggagggagaccatcatcttaagtggatcttatcccttgacttattaagtatgctactcttgaaaaaaaaaaaaacaaacaccttatttagcagaagtagaatgcagtggtgtagtctaaacttttgtttgtcttttgtttttttaatgtctcctcacttatccttttttttcttaactttttttttatttgaattaggaacaggattgttttacatgacaatcccatttcccttcgcccacccgtcctccctacccccccccccccccccccccccaattttttttttttttttttttttttctgagactgtttctctgtgtaatagccttgactgtcttggaattccatttgtagactgtgctggccaactcacttgcctctgccttctggatgctgggatcaaaggtatggctttttacaggctaggatgaacttctgaaagctaatgttttgtctgtctttcctttttgagtcagtatctggaacatgctgcagtcctcctgtctctgctcccccacccccatccattttagcattataggcatgctttactaagcccagtctcctctgtaaaattaaaggtagttccctacatcatttgctttttttttttttttttttgagacaaggtttctgtgtagccctggctttccttgaacttgctctataagaagaccaggttggcttcaaactcagagatctgcctgtcgtctgcctcccaagcgccaggactaaaggcatgcaccaccatggccggcctcatttgcaggtttattctgatgattagtatgtgagagtggcatgtgaaatgctttagcggtacttggcacattgtttagctgctgttagttgctgaggatagtcacataggtgacttaggatcccacacttcatgggggtcctgcatagataaatggggaatggcagataaagtgtgtaaatcttttttcagatttatttgattttatgtgagaagtggaatatatcatgttaataaaatgacagtgaatttcagctggatttgtgcctaggaagtaccaaatgacaagaaaacctattacagaattcttcatagccttgacgctctttcttctcagatggtcctttctgtctacttacctgagaatacaaacttgcagactaagctatatcagggttatgagaatatcttcattttgtaattttattttgcctagcaaggtaaagtgtgaaattaataatgtgtcgaaaagtatataaatcagtgacccttgtcgggcgttggtggtgcacacctttattcccagcactcgggaggcagaggagatctctgagttccaggccagcctggtctacagagcgagtgccaggataggctccaaagctacacagagaaaccctgtctcaaaaaaaccaaataaataaataaataaataaataaataaataaataaataaataaatcagtgacccttgaaagaagcctaaacacatggagcagtatggtagttacagatatttcttacagtagagaggttctgtgcattcattactataaaaagatgtaagaattgtcctcttgagaagtgtttccttatgtggcacatagctattagcatgataaaagagaaatggaaatgtaccagagagaccttgttgaggataaactcattaccccttattttctctcctctaggcccactactgtctctaaccctaatctctggttgacttagttacttgtctgtatccatgagcttcctttcctctgagatgatcaaattattttcctgctcctttttgttggtattccttctagttactggattatcctaaactcctactttcagcatagcccatgctgatttcaaactcctgattctcttgtctctcaccttgcaagtactgagattgaaagcatgagccatcatgcctggacaggattgctataaatgacagtagagatgaagtgggaaagaaaatgcaatattggtttaatagcacacacctgtaatcccaggatttgggaggtggaggcaggaggattattacaaagtgccaagccagcctgagcctgggctttgtctcaaaacaaaacaaaacaaaacaaaacaaacccccgcttaaacaataactcttcgcggggccagatctcgtttaaggccatcctggactacagaatgagtgccaggacagccagggctacacagagaaaccctgactcaaaaaaaaaaaaaaaaaaaaaaaaaaaaaattgactcttgcaggtcatggtgtgtgcctgtaattctgctttttgggaggctgaggtgggaggatggaaattttgaggtctctctgtgctgtatagtcagactgtcttataatggggaagccaaatgaaaaactaaaaggatttgtttcttccttctgtttcgtattgctataatttaaatttttttgtttgtttttcgattcagggtttctcgtgtagctttggagcccatcctggcactcactctggagaccaggctggcctcgaactcacagagatctgcctgcctctgcctcctgagtgctgggaataaaggcatgcgccaccaacacctggcttgtattgctataattaaacgcagaaatcaaagtaaaattcagagtgacctatgtaaaattctgaatttataactctggattggcagacttaaattaaattagttgatggctacaaatatgtaatctaacctctctggtagcccaagttaaatgttactgtcaggcatgcacacagcccttgacacacacacacacacaaaccaccacacacacccacacacacacacacatannnnnnnnnnnnnnnnnnnnnnnncccctttgactttttctcttttaaaaatgttgcctcattcctttgttaattttggtcatcatgtagaggtcctgcctgcttttaatttttcaaaaccacatgagaacaaacattcacatagcacagatttattcatttaggtctcataaccctagagcaataataaacacacccacagtttcctggaattcacaacactcctgaccactaccaccccctgccccataaaaactaatatgccagtggtatttttctgcactataaaaatgtgacaagtttttattgacttcagtgctttttatttctttctagaaaaagtactgtcagccttgaggagaggtgacgggcagaaacatctctttttttcccccttttagttttacttttacccaggttggcctgaaactcagaaattttcctgcctatgcctcaagaattgcaggtgtgaactaccacattcaaccccctccatctctgtctctctctcatctctatatctgtatctttatttttgtttttcaaggcatggtttctctgtgtagtctggctgatctggaacttgctctgtagaacaggctggtctcaaactcactgagaacttcctgcctctgctccccaagtgctggaattgttttaattatttggtttatatgtatggtgtttagtctgtgtatatgtctttgtactacatatgtgcttggggcccagaagatggtttctatcccttgggactggaattgcagttgagttgggaaccaccatttgggtgctggaaaccaacctgagtcttctgggaggacagccagtgagtgctctttaaacagccgagccatttttctggccatttgtttttgtttccttttacagtgctgatatgacttgagtttgtcaagtaaactaccactgaatgatagcccaggagaatctttttttttgtgagacagaaccttcctatgtatcccaggctagtctggaagtgactgtgtaacccaggttggcttctgtgtgcaatgatcttcccacttctgcctcccaggtgttagggtggctttattttagtttttatctttttttctttccccaagacagggtttctctgtgaaacagtcctggctgtcctggaactcactctgtagatcagactggagacaagctctcacttaatgatctagactgatctcctatttgtggactaaagtgatccttagctgcccaaatactggtattgtaggtatatactactgtgcatagctcctgattgtatttgtattactgtttatttatttttcatttttatttatttatttattgagacaatctatgtagcccaggctacccttgaattcgttctgtagcccagaactgaaactaaggtagttctattgcttcagcctccctcctgtaggatcaaaggtgtatgtgtgtgtgtatgtatgtatgtatgtatgtatgtatgtatgtatgtatgtatgttcttggttctataatattttattttttaagttaaatttatttagccttggttggggatatagttcagtgatagaacaaattctgtatttgatcctttgcatacacatgatgcccccacatttagttttttgtttgtttgtgtttttccaagacagggtttctctgtggctttggaggctgtcctggaactagctggtctcaaactcacagagatccacctgcctctgcctcccaagtgctggaactaaaggcgtgcgtcaccaccacctggccccaagtttagtttttaaatacagtttttgttttcagtttttttgtttgtttgtttgtttaagttagggcctctctttgtagcctgtgctgtcctggaactcattctgtagaccaggctgtcctccatcttacagaaatctgcctgtctgtgtctcctgagtgctgggatcaaatgtgtgcaataccaagcccagctgtttatattgttttgaaagtgtgtgtgtgtgtgtgtgtgtgtgtgtgtgtgtgtgtgtgagagagagagagagagagagccagatgcattggatttcctggtgctgagaattagagacagttgtgaggtgcctcactgttaggaactgaactggggtccttgagaagagctccaagtactttaaaacttgtagggcatctttccagcatactcgtttattttttttcctgattagaaaaaaaaaacacataaaaattgcacatacttgggtaacacgttttgatacggttttcacttgaagagatgatcactcttcttctgagggtgggtgggacctgggacattactgatttaggctaagagagggaggtgcctgctttggaccagaataacattaacagtggatgttgaaatagtttcattcacgtatgtctaccttctttttcctttttcttttctctctttctctcttctctctttctctctctctgcccccccctctctctctcacctctctctctctctctctctctctctctctctctctctctctggtttttcaagacaggaattctgtgtataatcactatgactgtcctagagatctgcctgccttaaaggtatgcaccaccatcaccaagctgaaattctgagtattttgaaggtagagttggtaggtgtcggttcataggttgttgtgcacccccctttgattgtgtgtgtgatgtgtacacataggctcctgtaccaaggtgtgcttgtggagattggagaacgacttggaggtgccagttttgccctatcatgtgagttcaggatatccactcaggcctcaggcttggcagtagatgccttgacaagcagaaccatcttgcttggactgctcttctactcttttttattttaaataatggaggtgtcatctgttgagagcttgtttttctcaattttaaaaattagatttattcaatttttgttttatgtatttagcctgtatctatgtatgtatgtatgtatgtatgtatgtatgtgcacatgtgcatgcttgttgtctctggaagtcagaagaaggcatcagctcctctggagccgaagttcagatggttgtgagccaccctgagcgtcctggaagttgagcctgtcttcattgtaagagcaacaagtgttcttaaccattgagtcatttctccagttcctattttatttatgtgtttttttttttcttttgttgttgtgattggtctgggattcactgtgtagaccaggctggacttgaactcaagaaattagcctgctccagcctcttaatagctggagttaaaggtatgagccatcatactcagcccaacttcttttatttaaagacaggttcttataactctgctggctttgaactctctgtcatctgaagatggtcttgaactcctgagttgccaatatttgtctgtggacttgggatggggacaggggagaaagtcaaggcagtgctaaaattattggttgaggttactagtttaaaatcgtttttttgtttgtttgtttttgtttttgttttgtttttcgagacagggtttctctgtggctttggaggctgtcctggaactagctcttgtagaccaggctggtctccaactcacagagatctgcctgcctctgcctcctgagtgctgggattaaaggcatgcgccaccaacacccggctggggttactagtttaaaattgttttaaaaaattattcttatttcatttgcattggtatgttacctgcatgtatgtctatgtgagagtgtcagatcttggagttgcagacaggtataagctgccatgtgggtgctggaacttgaacctgagtcctctggaagaacagccagcactcttaactgcagagccattctctagcccccaaggttactagtttaatacttggagaatactttagtaggcatgggtaggaaacacagaatgtcagatgggttggttgtggggctttgaggaatatgtcaccagacccagcccagcctaatttcaattagttaattaaattttttatagggtctggggacatgaatgagttggtagaatgcatgcgacatatgcattaagctttgagtttgctctagggcacttcataaatcaagcagaagttcctaggaaatagaggcaaaatcagaagttcaaggccaaaattttactccattacgtatcaaggttgaggccagcctgagatatatgagaatcttgtttcaaaaaagcaaagacaacattaaaaaaaaaaaaaaaaaaaaaaaaaaaaaaaaagaaaagacaaaagtagacaacaaagcactcaggaagctgaggaaatagttcagtgaagagtttgctgaggtaaagtttttgctgtgcaagcatgggacttgagtttggatccccagccccaatataaaacccaggtgtggtggctgatggggaaacaggtataccctggggcccagtagaactagctacagtatagtgagagaccttgtctcagaaaataaggtagagagtgatagacaaacataactgacattgacctcttacatccatgtgtatacatttagttgagtgcacctgcatacattatgtattatgtgcacacacaaatgtctagcaatgaagtgaactgcagaaagttaccatttatcttatcactgaaaaattatatgctgagatttttgtatatctttatacaactataatacataaacatgatgtatttaaaaaatgaacttttactactttgcagtctgtaacctcaatcagatggtaagtctacaagactacatcttttactatgatttcctcaatatttgttgtaagatatctttaaagtgataatagctttcctgtcagagaaagctgcaaatgcactggttctggtggcacatgccgataggatttgctgaaggaggcggagacaggaggatcaagagtttgaggccactccaaagcaatgcagagaaaccctggggggggggggacaaaaaacaaaaaaacaaaaaaaaaacccaacaacaaacaaaagagtttgaggccagcctgggctacacatttgccaggcggtggtggcacatgcctttaatcccagcactcaggaggcagaggcaggggaacctctgggagtttgaggccagcctggtctacaaagctacacagagaaaccctgttttgaaaaaatttaaaaaaaaaaaaaagctgcaaatgactgtgtaataaaagcagatggttatctggctgaccacttcatgggtctgtcaagcagcatttccacccttttttctcagaaagtgtaaggttgtccatttcggaattacttgaatctagttgaatctgttatctctggttttcattagcagtagaaaaagcaaataatgaagctgtgaagttctgtaagtagatacaactgttctggaagtgaattagtccctttctgccatttgacactgcaactcagatactttgttccggcctcccaagagcacctgcacaccatgctgtataatctcccacacaaacacaaataaaaataaaaaaaaaaaattgggctggagagatggctcagtgattaagagcactgactgctcttccaaaggacctagattcaattcccagcatccacatggcagtttacaaatgtctgtaactccagttctaggggtaaagaaatggctcagccgttaactacaccatcttctctgtcagaggactggggttcagttcccagcacccacatgacaggtcacagctgtctgtaactccagtttcaatggatctgacatcctcataccaatgcacataaaatgaaaataactaaaaattaattattaaaaaactccatttctagagaatctggcaccctcatataggcatacgtgcagacaaaacaccactgcacataatataaacctaaaacaaatgaaaaaaatttaaatcttgccaatttttatgtgaccactggtcaccatcaataaaatgaacattgactgcatttttgatattataagatatagaacatcttcagtgtttttctgatttgatcaatactttgattttttacaattgtcaatgctgagaatgatatataatatgtagtacaaaatgccaaagtgtgtttagaccaagccaggcattggtggcccacccttttagtcccagcactcaggaagcagaggcaggcagatctctgtgagttcgagaccagcctggtctacaagagttagttccaggacagcctccaaagccacagagaaaccctgtctcaaaaaacagaaaaaaaaagtatgtttagaccatttcagaaattgtgtcctaggccaggtatgctagcacatgcctttgatctcagcactagttagtacataggcagacagagctcttgggttcagggcttacctggtctatagaaggagttccaggatagccagggctacagagagaaaaagccctgtcttgagaaaacaaacaaaaagggatattttcatttgtttgtgtgtctgcctgtatctgcaatgtgtatacagttgccagtggaggccagaagagaacactgcattccttagaactgaagttaataggtgatgctgggacctgaactctgagaagcaataaatgctcttttatttattttattattattattttgggttttggtttttcgagacagtgtttctctgtgtagttttggagcctgtcttggcacctgctctgtagaccaggctggtcttgaactcccaaagattctccctgcctctgccaccaccaccacctcccggcctgctgaactttctttctaggacctgttttccctatttgattttgaatttttggatggtgcatgttagaaatctacattaccacctcacacattcagttctgtgacttcatatgggatttgtgacagtttaatatgctggtgactgtggcataaaatcatctgtcatccatgagtttttaatttgcacaagaaataaatcatggggctgaagagatggctcagctggttttccagaggtcctgagttcaattcccagcaaacacatgatggctcacaaccatctgtaatgagatctggtgccctcttctggcctgcagggatacatgcatacagaacactgtatacataataaataatcttcttcttcttcttcttcttcttcttcttcttcttcttcttcttcttcttcttcttcttcttcctcctcctcctccctcctcctcctcttcttcttcttcttcttcttcttcttcttcttcttctatcgtttttttcagacagtttctctgtagctttggagcctgtcctagaacttgctctgtagaccaggctgggtttgaactcagagatctgcctgcctctgcctcccaagtgctgggattaaaggagtcacctggtaaataaataaattttgaaaggaaaaaaaagaaagaaatcactggctgggtatagtggtgtacaggtttaatctcagcattctgatcatattaattgcagcacttgggaggcaggggtaggtgggttttggtgaattgaagggcagcctggtctatgtaatgaatttcaggaagctgagattacatagtgagactgtgtctcaaaaataaataaataaaagtcactggtttaaatttgataatgtactttttttaagtgtgtgtatctgtctgctagtatgtgcatgtgagtgcaggtatgtgagctgctgcacatgggtgctgaatctcctctccagcctctaaatttgccaatattgatcaacttttttttttttttttcaaggcagggtttctctgtggctttggaggctgtcctggaactagctcttgtagaccaggctggccttgaactcacagagatcctcctgcctctgcctcccgagtgctgggattaaaggcgtgccgccaccaccgcccggctgataatcttttaaaacctttttttaaaaagatttatttatttactatgtatatagtgttttatctgcatatatccctgccagaagagggcattggatctcatagatggttgtgagtcatcatgtggttgctgggaactgaactcagaacctctaggaagagcagtcagtgttctgaacctttgagccatttctccagcccttaaaacctgtgggttggttctctcttaccacgcggttccaggggattgaattcaggtcatcaaatttgatgacaagcacctttacttgctgagtcatctttctggcactatgcctatttttctttcaagacggggtttctctgtgtagcatggctgtcctggaactcactatgtagaccaggctggcctcaaactcacagagataggcctgactctgcctgccgagagctgggtttaaaggtatgccacccagcctggctttaaaaaatgattttgtcttttatttttatttctacatttatttttaatttttaaaaaaggtctggctatattgccctgactggctcagatgcttgctatgtgtaccaggctggccaccaaaagttataggtaaataagtaaagcttattgttacacttcgagattacagtatttgtgtttggaagataaaaagcctattttagtgatgattttggtctttgtgcagacaataaaatgaaaatactggtttgggcttggtgtctttatagctagcattgttctgactccatggagtggatgtattgaaccaggtgttttacttcagctgtaccatctgtgggagcaggtggacagatcctctgtcatcaggaaaacacagctggtgagacttagatctaattggttgctttcctagctctttctagtcacatatacctgaatgcagtttacctcagtaaatgtgttgattttggttaggacattaacagcaaaagtgaacaaaaaagtaaaaaggtgtgagtatgtatgtattgagacattgcctgctgccttggaaatagtattatcctgtctcatcctcccaaattcttggattgcaggggtatgttactacacccacccctgcgtttttggatttatatcgagaaaaataatttaagggtttatttatttatttatttatttgtatttaactttgtgtgattatgttcatgtgtgtgcttatgcctttggagaccagtagatgttctttctgtgatgccattcactttgattttgagagtcttcctaacctcactgataggctagactggctggtgtagactgagttttttttttttttttctgcctggtcccgcagccgtttagctccaaataaacacacagagatttatattaattataaagtgtttggctgatggcttgggcttcttactggctagctctctcttaattattaacccataaatattaatctatatatttctacatggccttatcttctcagtagctacatggaatctccctggaagctcgtttctgcctcctctcaccaggattcccctctggtagctccgccaatacttcctgcctcgctactggctaagtgttttattcatcaaccaataagagaaacatatttacatattctccatcaagctggtatcaaatcccaggggtctgcctgttccctccttctcagcgcactcatcacaccagcattttttgttggtattaaatgctttaccaactgagccatctttccagtgatgggggatgtccttctgtatgtatgtttctcatattggttgatgagtaaaacactgtttggccaatgaggcaggaagataggtgggactaaggacgaggagaattctgggaaaggtaggcagagtgagcccaccaaagagaggagccatgtaaggaccaggaaggatgaatcaggtgtttttcagcaagataagaccacgtggaaatacatagattagtagaaatgggttaattaagacagagctagccaataagaagccctagtcactggccaattaatatagcatctgtgtgtgtatttggggctgagaagggtggcgggacctggtgggaaaagaaaaatccaccaataccagaacctgatttatctttgtaaaagagttgtgtgggtggtggtggtggtggtggtggtggtggtgggtgggagcccctgtgtgtatgggggttccaaggttggaagagaatattaggtattctgcttttatcacactttatcttagtcccttcagacatggtgtctcactgaacccaaaggtagcctggtgactggcagggcctcagtgatcctcctctttgtcaccaatacacagccataccctctccttttgttttgtttgtctattttgagtcagggtttcactgtagccatgacaatcctaaaatatggtatgtagaccagactggcctctaactcgtagagatctgcctgcctctgcctccttgagtgcaggaggtattaaagtcatgcactaccaagcccattgggggactatttttaattctttgtattcttaaaaataacttagcaaatgtctcatagatgcttaaaataaataatcatggttgtgtcattcctttggtgtcgtcggtgtagtggtacataaagtgatagccacgtcatgcagtggtggcacacacctttaatcccagcacttgggaggcagaggcaggcagatcaattggaaaataaagtgtttctttttcagttctggagatcaaatctaggactttatacttggtaaagatgatctaaaaccaagttacatgtccaatccttggtttgttaaaatagggcctcactgtgtagatctagctgtcctggtattagctgtgtttctctgcccctttttgggggtgggggtgggggtgggggnnnnnnnnnnnnnnnnnnnnnnnnnnnnnnnnnnnnnnnnnnnnnccaccacctggcaggcctctttttttttttagattcatttattttatgtttgtgggagttttgctttcatgccattacattgcctgcctggtgcccttggagttcagaagagggtgccagatcccttggaactggggttacaggtagttgtgagccaaaatgtgggtgctagaaatggaacctgggttctctgcaagagcagaacgattttaactgctgaaacatctctccagacccttttccctggcccccccacctcgtatttcaagacagggtttctctgtgtagctttggagcctgtcctggaactagctctgtacaccaggctggcttggaactcacagagatctgcctacctctgcctctcaagcgctggcttatttttttaaagcttttttaggtagtgtttcattatgttgcctatgcaggcctggagctgctagacccaagcagtcttttctgcctcatgctctagagttcagaatacaggtttgagctaccatgtctgtttttaaaactattatgtgtatggatgttttgcccatatgtgtgtgtctgtgcaccatatttgtgcaatgcccgtaagggtcagaagagggcagtgtattccctagaactggagatgcagataagtgtgggtgctggggattgaattctggtcctggaagagcagccagtgttcttaactgctgagacagctctccaggttctataatcttttgtttccgggaggatcttgaattccctatcctgtcagagtttcctgaatgttggggttgcaggcgtccaataccatgtctggtttcattattctttattatatatttcttcctccttcttctccctactcttttttttttttttttttttttttttttttttttttcttttttattacagcagttcttctgtctcagtcttccaagtactaggatgacagaggtataccaccaggactgatttcatgcctgtttctctctcattggaaataggctgcttacataatatgtagtatagttaaggacaaagaatcactgtacttatgtgcctattcatgacctgattgttggaagcatcataaaaatttctatgggtctttcaggaaagtaaagatggtttttgttttgtttttttttcaggatagggtttgtttttatggccctgactgtcctggagcttgttctgtagatcaggctggcctggagctcatagatccacctgcctctgcctcccaagtgctgagactaaagttgtttaccaccatgcctggcttaaagattttttttttttaaatagggtgtaatagggatgaattaaaggtttggggtatagcttaatcacggagcacttgactagcatgggtgctgacattcttggtccagtccttagaactgcttcagaaaagatggaattgagagcaatgatttttagggactgtcagggtgtaatgttttataaacacttgttttgaaggaagggtatgatttcacagctaagctgggggatgatggaaatgtcacagcagactgatgggggccatagttcaggtatatatagtgtttttaacaaagcctggaggtgggaaagaaccagagacgcctgcagaatagctaccgttgtcatttaaaccagagtgcatctgagactgttagaggagatccttttcaccttgtatttgattattttgaaaggtatttttcttgaactgttgccccgttattataaaaagagattctgttgtagttccacatcgaaactgcttcattcttcattccttctgggccttcctaataatgtctggagttacattggacttcatgtgttcctgtgcagaacaaaagcacatgatcattgaagcctgtagcataaatgagaggcttgtgcgggtggtgtgaaaggagctctcccagcctcacatgcctgggtgggcgagctacactaatagctcccagcagttctgaatcagacattgtggagccaggagtctagcatttggaattccattgcctgtgctaagggtctgtcttttatcctccaaaccaccatttgttaaatggcagtggacctgttgacaagagggggaagactggcaaagatcaagttaaaaggaggaaaaagttcaaaggtaggaaaataagacgaagggtttagtcatgtctttacctcccctcccagccccacctccctttggagacaggatctcaatatgtagccctggctggcctgcaactagtagaccaggttgacctggaattcaagagatgttcagcctgcctctgggccgacaatgtaggttaccactctggcttttttttttttttttaatccatctgttaattatttaattttaggattttggtaattcattacatagaatttcattcctgaaagctgggcttgtgtgtgtgtgtgtgtgtgtgtgtgtgtgtgtgtgtgaatatgtgtgtgtgtgtgtttctttaatcccagcacttgggaggcagaggcaggtgggtctctgtgagttcgaggccagcctggtctacaagatcgagtgtccagaccggctccaaagctacacagagaatccctgtctcgaaaaaccaaaacaaaaaaccaaataaacaaaaaacaacatttcaaagcatgttgaaccaaggttgattctctgtgagaagaccaatgagaggacagaggccatgtctctgtcatattttggttgttttttagttaaatgagccagaacagtcttcactttagcttttataaaagtggacaggcagggtggagatgggtgggtggatactgtgagtagtgtgctatagattgataaaatagtgagttacctgctaccaccttctaatttatgctgccttctctttttcaaggattcctttcagttttaaacccattgttttcactgtccatagatgttgtccatttggcttgttttcctgtgttttcagatctaggtgtttctaattgcatggatttttcagggatgcagtgatttttactggtgctttcttctgaagcctttctttcttgcatacacttttatattctttttttaagattttatttatttatttattatatatacaacattctgcttccatgtatatctgcacaccagaagaggacaccacatctcataacagatggttgtgcgccaccatgtgtttctgggaattgaactcaggacttctggaagagcagtcacctttatattctttatcttgaaaaaataagagatatatggccaaggatgaagctaggttcgtagaatgcatgaccaccatctacaatgcccaggatttgatctccggcaccacataaactgagtgaggtattgtgtatctgcgttatattctgaggacagcttagagtccatggcttaaaacttgtaatcgactcacaataaactatatatttcaagtgtataagtgggtctagggagatgccatagtggttagttttcactgtgtaactctagcttgtttggagttagcgatgttgtacaagctgactctcccacccccattatctatattgtttatgtgtatgggtgtttgtgcaccacttgcatgcttttcgtccttggaaaccagaagagggtattgcatccctctggaactagagttgaaaatagtttatgaggccgtggtggtgcatgtctttagtcccagtactcgggaggcagaggcgggccgaactctgtgagttgaggccagcctggtctacagagatacacagagaaaccctatcacgggggaaaaaaaaaaagagaatagtttatgtgggtgctgggacttgaacctgggcctatagaagagcagttagggctttttttttttttaaatcatttttttattctaaaaacagtctttcttattttacataccaatcccatttcccactccctcccctcctcctgctaccctctcttttccccattccttcccctaccctctccttagagagggtaaggcttccatgggagtcaaggaactctggcaccttactttgaggcgcagtcagtgctcttactcactgattcttcttcatcccagccctctcctgccttatgtattttttaaattgttttaggggttcttgtattttgaggctgggtctcaccaagtaacttggcaaatagaacaagctggcctcaaattcacagatctagtttcatctttacacgtgcttcgattaaaggcatgcattaccatgtctggctttaaatttttatttattcattttaattttaaaaatgtattttaggccaggcattgtggttcatccctttgatcccagcacttaggaagcagattcagaggatctttgtgagtttgagaccagtttggtctacataatgagttccagggcattgtagaaaagccctgtttcaaagataatctaaataaataagtaaatataatacacacaacaaataaattgtatgtgtagttgttttgtctgcataccatgttagtgtctggtgccaaggaggccaggagagggtgttgtgtcctttgagactggagttagaaagtttttagataccatgtgggtactggggtttgaaactgggtcctttgaaagagtagccagtactcttaattcttgagacatctttccagtccctcaatttttaattgtttttatttactttttattttattattatttttgtttatttttagagacagggtttctcttagtaaccctggctgtcctggaactccatctgtagaccaggctggcctccaattcaaggatctgctgcctctgcctcccaagtgctgggattaaacgcatgagccaccaatgcctggtatgcctcagaattcatctgtctatccacctacctccctctctccctccctacctaatctatctagtttcttgagatagggtttctctatgtaaatctggttgtcctagaatttgctctatagattagactgacctcaaattcaccttgatctgaatgcctctgcctccctagtggcaggattaaaggcatgcaccatcgctgcctggcctgaacttttatttttaattatgtgggtttatgtatggagtgcagtgcccacagaggccagaagaggatgttggattccctgaggctagactagagttacaagccactgggaactccctgagtggatactgggaaccaaattctgcaagagcaccaagtgcaacccccccccccaaaaaaaaaaaaacagggtttctctgtggctttggaggctgtcctggaactagctcttgtagaccaggctggtctcgaactcacagagatccgcctgcctctgcctgtcgagtgctgggattaaaggcgtgcaccaccggtggcgccaagttctcttaacctaagtcatctctcatttctgtttttgttttgagacttcttagggttgcctttgaactcactatttagctgaagatgaccttgatgtacttaattacttgagttctggaattacaagtttatgtatgtcattccaccctcccagtctctcatcccaacctcttttgtttatttacttatttaacttattgagacagtctctctaagctgctcactagtcttgaactcaccatattgtccaggatagctttgaccttgggatactcctgcctcagctttccacatagcttacactgtcaccagcccaggtctcttaagtctttagacacagctttcagaagtctttggaaactatttgctttctgatataaggagtttgattcttttctctcccttgtggggagggcaccattcttcttaacaagttgcttttattgggaaataatatttagaaaccataatgttcatgctagaacttactatatagataagttggccttaaacttgctctggtagccgggctgtggtggcacacacctttaacttgggaggcagagagaggcaggtggatctctgtaacaataaatctttctgccaagccacccgagccccactgccacaataaggtcccaagtaacacagagagacttatattaggtacagtgctgctggccaatgactaggatttcttactaatctttattaatctatatattttataaagacttatctgatcaaggacgccggcggcatgcatcctctcttgtctcaatcacatggcggccatgtccctttcctacatttcccagaatcctccttctctcctagtctcacctaacttgctccccctattggccaacggtgctttatttgtcaaccagtaagacaaacatatacgcagaagtacctcttcctcatcagatctctatgaattccaggacagcctggtctacagggtgagttccaggacagctagcgctacacagaaaagccctatcttggaaaaacaaacaacaacaacaacaaaacttgagtgctcttcctgcttcagcctcttgactgttgctgggattacaggcacagtttaagagaactgtccttttcctttgttagaagctaaacattaaaacaaaaaactaaacattaaaacaaacaaaacataaaacatttgagggctggagagatggctcagtgtttaagagcatgactgctcttccagaggactcgggttcaaatcccagcccccacatggagctcacaactgtcgtaagtacacctgtgtgagtacaccctcacacagacaaacataaaaataaataataagaaagaaaactaactaaccaaaaaaccctaaacatgtattatattatctactttctgtgggtcttagttccaatgggtcataatcttgtactgaggactggagagatggctcagtggttaaagagtacttgttgctctttcagaggacccaggttctattcccagtctcctcttgttggcttataactatttgtaaactccagttccagagtatctgataccctcttgatctctgaaggcaccagccactcataaacattaaacaaacaatcaaataaataaaaagattccttacttatatagtgacaagaaattggcaagaaatcttaattccttgtcaggtggttctagaggtgcttgaatatttccatgacttggtagttctccagaatgagtaatttagaataaccccttgattcccttttccctccctccctctctttctcccttccctcttcctcctttccttctctcctttccttactttgctaggatcagtaaatactaagcagtgtggtgtgactgttgcccaggctggatttgaactcccagatttacacaatgtagtcccaagtagctgggactacagttgtgtgcccctgcatcctgcttaagtagtctagtcttgattaatttcttacttgataatattgtatagtactctgggtaagaattcagacatgccgctgacaccagtcaaaagttaatatatttgttttttactttccttgcaacaccaagataataatgtttaccaaatgtgttctgctttattgactctttgtaacaatcaaggaaataaaggtagtccttgatactcattgcttaaaataaaatcttgctactgcatcagttagtgtttctgcccactgcctctggggggtgatggcgagtcttcctttcttgtaaaatgtcatgcttgtaggcttcatttatccaaagtatggtagaggcgaaaggaaggcatatctatttgattatgtatgtgaaggatcttcattcattttgtttgtttttccagacagggtttctccgtgtagctgtcctggaactcactctgtagaccaggctggcctcaaactcatggagatccacctgcttctgcctcccaaatgcttagattaaaggcctttgccaccactgcctggcttagatcttcattcttaatgcatgttcttgtaaatgttatgtagcatatatgttcatgtaatatgacctgggaagaagacaaaacccctcctccattttaatctttagtctaaaaaaatatccacaggaaatttaaaaagtatacagagaagcttaagacccttcacccattttacccagtggtaagattgtgtataataactggtacattgtcagctttcagataccagttttcatgcagcagaaattgataagcattgtcttgtattagctcttgggaagtgctaaggattaaacttgttagtcgtgtggatctatcttcttgtctagagtctcaaaataattatgtcaattttactgtattcttcagttttgaaacaaacttacatacagttctaaatgttaatcatggggagcctcacattcgtgtttgcttggttttaaagctctttttgtaacttgtcttcatctttcacttacagtctttgcagcaccagaaccgtgttgtctgcattgtcttaatttcatcacgtgccatttttgcagagcacccagtctggatctgggaggcagcttgtgtgaatcatttacatatatttctgcttattcccaaaactaatttgcagctttttatttttgatccaattatacacttaaaatgtgtttacaatttattttatgaagacttttgtctcatagggtttaaaaaccagtccaaagaccagaagttattaaacaatagcaaaaacctacacaatatgtaggactttaaatggtgattgttaaacatttgattgtcccccaaaatgtgagtctgtgtgctcatgtatgactatacatttattctattagtgactgaaataaataagttttgcacattattcttcctgttattctcagccgtaaacaaattacatgcatttaacaagttagtgttagattggccaggagccactaggaggcgtgtacttagtgacatcagctggcaaagtgccctgatagcagagagggtggaaggggtagtggagagagaggaaacaggagggagggagggagggagggagggagggagggagggagagagggagagannnnnnnnnntttttttggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctgcgattgggctttgaagattagggggagaaaagagagctttttaatacctatttcaagtagatttggtatatttacgcgtctggagtttttaatttggacattcagggtaagtgtacattttaatttagttctgggtgataaagtgcacaattctgccattccaaagctttttgcttatctcgaattgtgtgtttatggatattctgtgggtttagtcctggtttcattttgatgcttcatttggttttatgtttctatttaatttttcattgccacctttgcatttttgaatggaaagtttagttaaaatcagatgtagttcataattctacagttagaaaagtagtcctacaaatacttctttaagctctcccatattgaatacttctggcatattctgagggaattgctttttcttaagttatgtataaaagcagtgaagttatgtataaagagaagactgctacaatgctcttttccattgtcagattttatttcaaagtaatcagacatgtaactaaaagagattgcagcaaagctagtgtcctctctgcattttatttacatcttgttatgttttgctcctatactatttttctatgactgaaataacatcaaatcagacttgaattgtgaattggagtgctcaggagtgtgctcacaacacacacacacacacacacacacacacaacacacacccctcttcaacccctactatgttctggagtctttgtcagttttgatgcctattggttatttatatagtgttactaatttttgaaagacttcccaatcagccccctacatgtagaacctgagtttagtatatactgtatatataggttttatttcttagttttctcatcttgtgcaatctgctgctctgagccccatttggtttgtttgctttcctgcctgcagctcccttttttctctttctcaactggatcttactatgtatctaggtacaccaggctagcttcccactcacagagatccaccctcccctgtctccctaaaggcatgtgccaccacagccagctgactcccaatttgtgacggtagtggggaaatgtgtccagagcctttccagcacatggaaggcagcttaaaattttttgaggtatttatttatttatttatttatttatttatttatttatttatttatttatttatgttgttgtggcaggttcctaaacccttttcacttccatattgagctataactgtatctggtctaacttgtgatttcagggtattattttgactgcatgtgtatctgtaccacacagatgcctgatgcccacagaggccagaaaagatcccctagaactggagttagagatggttgtcagctgcattgtgggtgctgggaattgaacccaggtccatctcttcagaccctgcacccaccttttagatagtttgtatttgttgtggtgtatgtcatctttgctaagcctttctatgactgtagagtttggaaagcattctgagtataaaatgcaaatgtaataaatattccctttaactgcaccagaatagaagacctttgaaaagtcaacttatccaagtgaagtattgattgtattactttgaaagagcatgtttatttaaaaaatattttcttttttcttttttttgaattagaaagaagattgttttacatgtcaaacccagttagttccctctccctccttccttatcacccccccaactaaaactctacctatcacctacccctcaaaaatatttttatgtttatttgtctattgctgttttttctatccattgtgtgggttccaggaatcaaatttaggtcatgtcaggcttggctgcaaagggcctttacccactgagccatctcactagtcgtcactatttaaattgtacctggctcccccaaaattctatgacatgacaaatgggagcttttaaaataacatttctttttaaataatttttagtattttaggtgtatgagtgttttggccgcatatatatgcaccacctgcaagcctgtgttcatagaagtcaaaagagggcatgggatcccctggaattagagttgcagatggctgtgtgccactctgtgtcttgcttcttcagaagagtatccagagttcttaacttctgagccatcactctactccccaataacttttattcagtaaagttcttcagctttatatcacctgagcattttaaggaaactgtagtgctttttgtttgtttaattaaagactgggtgtctcagtatccctcagtagctggaatttgctttgtaggctctcttggcctcagacttgtagcaataccctgtgtgcctcctgggttaggagaacaggcatgcacctggctgtaatgcactgtaatgcagcataatgctcacattctcttctctctaaaaaatggagttttacctccatttccctcaagtagtaagaactttttaaatggattttgtttgtttgcttgttttgttttttcgtttttcaagatagggttgctctgtgtatcactggtagccctggctctctgtagaccaggctagcctcggactcagagatttgcctgcctctgcctcccaagctctgggattaaaggtgtgtgccaccatcatgcccagctttaaatggatctttttagaaatttctttaatgttaaattgactgaatttgtagaacaaatttaggaagttttgataggtgcagtggacagcagctgagacttgtttgactatttgagaggctataatgtaacatcaaatttacatggtcctccttcagtgaacagtattgtatctttaggacctatgttcttgaagatgaatggggagaaaaggacttaatgctgaaagtgtagtgtaggctgtagtctgatatgggagagcctaaaaaggtttattttttaaaattattactgctatatgtccattctggcaataatgtttcatattttgaggctcaggatttcatctaagaccttgtgcatgctaaaaaagcatgtgttctatcagctattagtggctaagttcctagccctcaggaatacattggtccaggtttggcatagaactatgtatgtagcccagccaggtcttaaactaacagtaattttccagtcagcctcccaaatgcttggataacaggttattttatcacatctgactaatataataatccatggaccccaaataaaagtgtttgattaacagtcctgattgggtgagatgaggccctgagttccgtgttcgcttgtgggtgggagtcccacctaaggctcagcagttaaaatcaaaaccaggcccagtggcacttgctgtcaattctagaactccaggaatcacaaacaggaggatctctatgagttcaaggccagcttgatctacaagtcaagttccaggatgccctttgaaaagaaagaccctgtttcaaaacaaataaaccaataagattataccattttttttttttttaagatttgttaccttttatgtgtgggcacatgagtgaatcaagtgtgcacttgcacaggccctatggaggtgtagtggggggtatgccccttggaacaggagttagaggtgtttgtgaactgcctagtgggttggttgcagggttctttggtagagcagtaagcactctttaactactgagccatctctccaacccataaccaaaaaaaatcttttgagttaaatattactgaggaaagtcatagtattttctgtggactgagaaagccccatatgtggaaaccagaggacagcttgcaggagtcagtttcttcttccacaatgagggtttcagagattaagctaagattgctaggctctttacctccaagtcatattggtgggcccagggaaggttctctttatttttaactttcattgattcttcgtggatttcacgtcattcattctgaccccacttacctctctgccccctcaaatctgacttctgccattgcagccttttccccataccaaggttctttatttttgtataatcttattaaatgcattattatatcttaagctgagggaatgaatggtcatcggtagagcattgcccagtcatgtgctagtttcagtctccagcaaggtgcatgtatgaggaaggggagagaatcctccctggccccatagtttttaataaccagtggctgagcttagaatggtattctggatttccagaatattcgtcgtactgtcttattttgtctatctacctatttatttatttatttgacagggtctcactgtgtagcctggctagcctggaatttacagagaccctcttgttattaattctggtttctgggattaaaaggtgtataccacaacacccaacattttacaaattctttattttatttttgagacagggtttttctgtgtgcagccctggctgtcctggaactcacaaagatcctctgcctcccaagtgctgggagtaaaggtgattatatgtgttcatgatatcttgaagttatttggaattttttcttagtattttctgataaggttttgccgagttgtccaagctggccatgctttcacaggtcctgggatttcagatgtgaaccaccatacctagttttgatattttggggggtagacaggggaagatgttaagacaggaactcagtgctagtatttgaattccttcccaggtagctatggagtacttgaatggatttagaggatcctcatgtctgcacctcccaatgctgtgattatagatgtgggtgtgaaccgttgtgcccagtttaggcttttttgtatataaatacatataattattattattattattatttttggttgtgaacccagcctttaacaactgaaccatctctctagcccagactttttttttatttaaaggtgagatcgtagaggagataaattaagaatgcacaaaatcaataagttctagaagtcattgccaacagagggaatcaaatcctttggagaggaggtaacatttgatttggaatccttgtgctttattgggggaatgatgggcagatagaaatatactagtttcagacggactgctcttccagaggtcctgagttcaattcccagcaaccacatggtggctcacaaccatctataatgagatctggtaccctcttctgactagcatgcaggcagaacactgtatacataataataaataaaatctttaaaagaaagaaagaaactagtttcaatccccagcaaggtgcttgcatggggagggggggaagaaagttctccctggcccagatttcagtaccttaattttatcaattgcatagttacactagtttttttcttctatatttttgattgggatggggggatcttatgatctagactggtcttgaactcattatgtagccaaggctggtctttagctcctaatcttcctgattactcacagctgctgagattacaagtatgtgccaccatactcagtagtatggtatgcgtttttgttgtttcttttaattttattattattattattattattattattattattattattattatgtgcattggtgttttgcctgcatgtatatcttgtgtgagggtgttgaatcatggagttaccgacagttgtgagctgccttgtgggggtactaggaattgaaccagggtcctctagaagatcagttagtgctcttaactgctgagccatctctccagctccaacttttatttttaaattatgtgtatatatctttgtgggagcatcagcatgtgagtgcaggtgcccaaagaggtcaaaagtattgaaacccttgtagcttgtgttacaggtggttgtgagtcaccagatacgtccaaagaactgaatttggtcctctggaagtctcttaactgtttaatgttctccggtgcctttgctgtgtttgaaatctatccctttctattgctatctttcagatccaagcacagttgtttgattgtaaggcatttagcaaaatacatacgtatttttccccttgaatttgtggtttatttctgctccaagttcaaatcaataaataaaggaattaatagtggttgtgtcttaaagaaaaaaaaaactgctaactgggttttacatagagttactgactgatggactggaaaattttttaaagatttatttatttattatgtatacagtattctgtctgcatatattcctgcagctcagaagagggcaccagatctcattacagatggttgtgagttgccatgtggtttctgggaattgaactcaggtcctctggaagagcagtgagtgctcttaacctctgagccatttctccaaccccgacagttaacttttaagaactatgttattaactgggcctggtagtgcaggcaggcctatactactggcttctcagtagaatcaaaagttcaaagcctagcaggactacagagtaggttcaaggtcagcctgggcaatttagtgagactttgtctcaaaatgaataaaaagtgtctatggagactgtagtaaaaatgcatgtattaggtcctaggttcaagccatagcaccagtaaaatagtcagccacaggtcctgagtgtgtaaaggccctgtgtttagtacccagcaatcaaagtgtacacacacacacacacacacacacacacacacacacacacacacacacacacacactttgttttgacagatttattcgaggaaattgaaaatgcatatgggtctggttttctaaagcaagcactccccatccctaggactttttgtgcttagtttaaagcaaccattagtgaaaatgctgttttcttcccatcctgagcagcttgttagcaaggtggggtacagttctgtgtaaaacatggatacatgctacctgcagtgacatctcatagctggagctaaaatgtaagtggagtatgtgttttcttttttctttgtttgttagaaataggttctcctgtagcccaggctggccttgacctctgtatagctgaggatagctttgatcttctgatcctcctgcttctacctcctgcctctaccaagtactgggattacaatcatgtagtacaatgcctagatttagacaattttcacttgattgtgttaagaaaaatgaagaaagaaaattagtgttaagaaaaatgaagaaagaaaattagtgtatgtaggctttagcattagattaggttgtgtaaccatgagcgttgattctaacatcctctaagcctgtttcttcaactgtaaaattgtagtaaaatgagttttaagcattaaattaatatatgctacatgaatacttaataaagtttatcttcctgtgtaatttgtctttgcccttccaacattgataagtcatagtaatgaaaaaagtttaattggaatctgaatgttttttaatatgtctcttttcagattgatggaactacctctgcttccttaactaattcttgtcacaagagagaggggttcagtacagaatgtagtagccttaaaaactcaaacctgttgctgtgtgtgtggcaagctgtttagggaccttgccttactttgctggaagagctgggggatgggccacttcgagggtgacagatgtgtcctctgctcccagcaccaggtgcagccattgttgtggctggtctcttcatccctcctgtctgttactctgctctttgtagctcattgtttctgtaggaaattagcattaaatccatctgaaaccccatgtccctcaactgcaggtgactgttactggccccagctgccacccttgcgcttgattacttccatatgggctgtgcaaagaagtagtagtcatttattgattttcaccacaagcccccgcctcaaaccataataacctgaaatctattaggcccccaataggctgtaactcagttggcaagtacaactgtgatgaacattttacaagcaaaactaattatgtcctttttcttccttcttagtcacctccttcctaaatatcagatggagaaaaacccgagttgtcatagtgcagtagtaatttgaactggctgcttctgagtagtcgagcttgaagagtttggatggacttgtctggaaaattatagccactattttaaatactttaatcatacctatagtgttcaagcaagccacggtataataggtccttagggtggagatgttcctgaagggacacaaatttttatcacctgtttcataaaattatttggggtgttcagtaaatttaaaaaaaaggggggacacctagtttaaaaggttgcttgaaaattatatgcaatcagtattagctaaatccttgtgttttgtatttatttccttgtttgtactgtggttctagtttacctcagatactgcagtaagatggttaatgtcctagacttcttcctttatcatgaaatttgtgtgtttcattctgggccttgttatgaattgattgtagtgagcatagtgacacatccctgagatcccagtttttacaagcctggagggtctcagccatgaggccagcctcacacagtaagttcaagtctagcctacctgtcaaaacaagatctcaaagaaaatttgttaaaaggtgaattggatttaaagccctaaatccaattttaaggacagtatgaagttgcttttggcttccaatgcttatgttgatttttgacaaagttaacaccacaccaatgaagagtatcctaatagcctgtagtttcacagcccttgaagtcaagttggctgacctgacctagtagattttatcaccaaatccttagtttgtaatattataactcagattaataagccatttaaagcgacagtttcattacttcaaagttagtttgtgaaatggggaatataggaccatttctgttgaggatatatctttttacttcttttttccccctgttttctttcttttggagtttaaagaggtttaggatttgaaaaactcttggtaaccggcactttacctggcaacttctctgaaggtgagcctccaggtaaagtggggtgaacctagaatagtttttttttttttttttttttttttttttttttttttttcgggcagggttttccccagagatccgcctgcctctgcctcctgagtgctgggattaaaggtgtgcgccaccaacgcccagtttaggttagtgttttgagagctttgaaatctgcttcttcattttggggttttgtttgttttgagacagggtctcactatgttgctctggctatcctggaacttactatgtaggctaggttggccttgaactcatagaaatcttcctgcttctctgtgtcctccagaatgctgggattaaaggcgtgaaccaccatgtctggtttttgcttcattgtaagcataagaaagatggaaagatttagagatatcaggtgtcttactgttctactgctgtgaagagacaccatgactacagcaactcttagaaaacatttaattgggccttgcttacagtttcagagggttattccattgtcactatgttggggagcatgggtgctggatctgatatagacttttgtttttaaggtttatttattatgtatacagtgtccctgcaggccagaagaggacaccagatctcacctcagatggttgtgagccatcatgtggttgctgggaattgaactcaggatccctggaaagagcagctagtgttcttaaccactgagccatctctctagcccctggtgtggacttttaaaaccttaaagcccacccccagtgtcacacttcctttaacaaggccacacctaccaatctttttcaagtagtgccactactaatcattcaaatatatggtcctatgggggcattcttactctaaccgccacatcagggaagagaaagagtggcatttgaaactgggtcttctgctcatagagttggtgtacattcatttgcaatttggaactagaataaacagttgggacagttgtaagtacaatattggtgtagctattactacttaaaaactgtcagaagacaggcataggggtacatgcctttaatccgaattgaaccatgctcctctagaagagcagccaatattcttaactgctgaaccatctctccagccccttataaaaatttagaggttaatttatttatgtattttatgcatttgggtattttgtctgcatttatgaataccagaaaagggcattgaatcccatgagactacagttagagacagttgtgagccaccatgtggatgctgggaatttaacgatagatctctggaagagcaaccttaccccttaattgctgagctatctctccagtcctctgatcagtcaagcaatcaattaattaatctttggcttttcaaaacagggtttctttgtgtagccatggctgtcctggaactaactctgtagaccatgctggcctggaactcacaagggttctgggaatatgattctcatccttgtactttttcaacaggcacttgactgactgagctagttcctcagtactaaaattaattttttgaaatactatgtagctatgtatgatgtgttatacctataacccaacactcaagaagctaagggagtaaggctgccatgaatttgaggttcacctgggctagaggtcccatttctaataaaaattaataaatgaagatccacttgcctttgcctccccagggctggcttttgtcttgtttaatttcattttttgaggttctcactgtatatagccttggctggcctggaattcacaaaaatctgctgcttctgcctcctgagagctcaaagatgctaccatgccttgcccatgatttaaagtgtggtgggcattttgagttttcaaaatgaagttagacaaataaacttggatactgtacacccatattttattagacacttgggatggcaaaattacttctgaaatatttctggcaatctcattttcatttttatctgtaggacaaaaaaatataaactttttttctttcagtagaccatatggtgtttgcacagactgcttatgtgaggtggctgtgttatttttctttcaggataaaatgctttacctgatgccaatgttctgaaacatttatttttctagtcattagtatgtgcagtaattattctaatcattctgtttttctttgctcctctcacacctccttagggtgtcatgtattctaggctagcctaaaactttctcaagcttagaatgactttgaatttctgatcttcctctttctaccttttgagtactaagattacagttctgtaccacacacataattttgagttactaagggtctaacccagggctcccttcattttaggcttagcactaccagataaaccattgcccccccccccaaaaaaaaaagagctcttggctgttcttgtttttgagacaatcttactgtgtgtccctggctgacctggaactcactatgtggattaaactgactttgaactcagagattcatattcctcaccctcatgaatgctaggattaaaggtaagacatgccctatcattcttagcctataatttcttttctttttttcttctggattctacagttaatgtgattctatagtttgtgtagtgcttaaccctaattttatatgagctttttaattttttaaaaagattttatttatttattatgtaattatgtatacagtcttctgcctgcatgccagcagagggcacaagatctcatttaaggtggttgtgagccaccatgtggttgctgggaattgaactcaggacctctggaaaaacagtcagtggctcttaatcgctgagccatctctgcagccccaagctttttaatttttaaagttgtctttttgggtcagtgatacggctcagtgaataaggacaactgccatacctgaccaacctcagttcaatccctgggatccacatggtacaaagagaaaaccagttccagaagaaggtgttggattctctagaactggtgttgcaactgagtcaccatatgggtgttgggaaccaaacttggatcgtctgcaggaacagcaagtgtcagtgagccatctctgaagctcccaaagatctccttttgcaataatagtaactatggtacttacatgtttactcagatggcataggtggctatttgctctgccaaagtgctcatctaccttccatttatgttgcttggattcagtccctgctatattataggctcatatttacattgtgcttttaatctggaaaagctttttatccccataaaggcccctcaggggcaggaagtaaaagctaggtgtaatgtttttatagaggtgaaacctgagaccacatcattctgctatcattttagttcttagataaggtctttttccatagttggactgcaaagagtgctttccaataggaagaacctccttcagttatgtggatagacctgagtgctgcctgaggaggcaccctaccaggagtgcctactggcacgaaggcagcatggttgctggtcatagagctaacagtctgacatctgcaagctacagctgtactgttttgctacagtctgtctatatttctgcttgcatttgtgaagaatcacagaatctggaagactgtaagttaaccattccaaacttggaagtttgctgtgtgtgggggagtattctgtactctggagagctgtccatgaaatctcatagttgatactgttctctcagttcatttattgccatctttagtttgtcattcctatgccagttttagtttaatgccagaataagattgagctatcatgatagatgaattgagtgggtgctaattgtgtcaccggagtgtctgccacaattttctctacctcatttggttcttctattctttagtttgttttggtaaacatataatacttggttacatttcaggtattactgagcagggttgcttgttgacctctctgctatcccacttaacacaggctctcagtaactaacccatcctgagtcctggcctcctattcatggtgacattcttcctgccccattctcccaagtgccacgattaaaggtgtgaaccatcattccaggcggtgtggtttgtttatttatgctttagagacaagattgtgtcttgtgtacctctggttgcttggtaaccaagcaactctgcagtcacactgagctctgggcaggcctcctgttactttctgattactggaattacaggcatgtgccagtacattgggtttatcagtcctggagattgaacccaggactttgtgctactaaagatgtattctaccaactgagccatattccaggtgtagtgtatttgttaactatattttaaggcatatctgttgctacttctaaaaccagcccattaatttgttaagggtgagaagcccttttgattgtcagggaggacataactgggctcttttatgtcatcagtgtcatttctcttaaattcctagtcaaaatgtacaaacttctgcttgcatttgtgaagaatcacagaatctggaagactgtaagttaaccattccaaacttggaagtttgctgtgtgtgggggagtattctgtggaatcttacaataattttctctttgttgttgttttgtttttgagacaggttctccctaattagctctggttgtcctggaactcacactgtagatcagcctggcctagaacttagagagatctgcctgcatcagcctcccaagtgctaggattaaaggcgtgcacctctcgttttggatttcttttgttactagttctaggctctaagtacaccacaactatcaacaacaaccaagcaatcctgaataacattatttctgtccttcagtttttggttaagtggtaaagaattggatatggttctgtacacctgttgtcccagcacttgggaggtagaggcaatatacttactagctagaggttcaaagccgggctcaggtatataggctagcattaggtaacataagaaccaataaataaaggaaaaaagaaaactatcttcttgtttgtatttctttttgagacagcctttcttgctgtcctggaatgaattctgtagatcaggctggctttggaactcaagagatcttcctgcctccgcttcttgagtgttaggattaaaaaggtgtgcactaccgagaattatttctaaggcaatttatgtatgattgagccatttttcattgagtaatgagtcttttttttttttgtagtagtagtagtatttcagttttttaaatagccctctccccagtagtcacattgaagtcagatctatggaaaaagacaatttgagcctaaagtttaatgtggaaataagataaactgtttctacatatttgttgaaagaaccattgttgacagtgggcgtttcttaaagaactcctgtattcactagtactgccccccccccactctccccttagtcatcttattgcaagctttcagagttgctgtagtgtgcagtgttccatggctggtgtaaaaactccctgcttgtaatgcctagagctgtcatccaaggagaccaaacacatggcactacactgcatttccagatgtccttccctctgtttgggtgacttggagctaagagaagggtgtttgctcttgaataggagaaaaaaaaaacattccttggcataaggcccaccctggcaccattcccacatctgctgttcattagaagtgaatgctggtcagtcaggatgtcagggtgctggtctgattatcaggcccaggcttcaagaagaaatagggcaggaaaataaagggtgactcagctaggtctgcagagaacctggaagaccctttcataccgtggtacattcctgagtgctttccatgtattaatcaaaatgtctgccatatagaaactgcccttagaaaggaaggagggggagtgccgtagaaaaaaatttttttttcaagacagggtttctctgtggctttggaggctgtcctgaaactagcttttgtaaaccaggctggtctcgaactcacagagatctgcctgcctctgactcccgagtgctaggattaaagatgtgcattctttacattaatattaatatcttggactatatcacccctccctaaaatatagaggtgttcttgaattttaaattttttctttttataaaactggtagttatagtgaaaaagttgcaaaacattaaattttcttgtttatttaaagttggatgtgtaggaggttacttactgtgattgaaaattttttttactctttactatttggggggcctgccacctcacccccaaataaatacacagacttattcttacttatgaatacccagcattagcttggcttatgtctaaccagcttttctcaacttaaatcccgtctaccttttgccttggggcttttacctttctctatctattctatatacatttctttccttcttactccgtggttgattatgtggatgggtgactggtccctggcatcctcttcttttctctctccttctcctttcttctatttattctctctgcctggtagctccacttatccctctcctgcctagctgttggccattcagctctttattagatcaatcaggtgtttaggcaggcaaagtaacacaacttcacagagttaaacaaatgcaacataaaagaatgcaacatatctttgcatcattaaacaaatattccacaacacaaacaatctaacacatcttaaaataacattccacaacaagttcagtgccacagcccgttaattcagcacccccagtgcaggaggcttaactgtgatgagcatgaggccagcctgggctacatgaaaccctgtctccaaaaacgttaaaataaaaagagggtttaggattatctagtaggacctggatttacctttaaaaaaaggaaagcagccaggggtggtgatgcttgtgtgcctttgatcctagcactcaggcagaggcaggttgacttcgtagttcaagtccagcctggtccacagatcaagttccatgacagccacggctacacaaagaaaccctgtcaaaaaaccaaaaaagaaaaagaaagaaagaaagaaaaaaaaccccgagatacttaagagtactctttgcatgtaaataaaaagcaaatgtgtttgatattctgactggacttgaccatagtgatgagggcaattgtagttctgaacctagctctttgggttcttaggacctgaggaacagaggccaaccttaggaaacaagaaagcacagtggtggatttagggaactgtgatgtgaagttttcagtgttcttcattatgtagttgctgataggaatgctcagcatttggtaggtctctgtttgagggggttttggttgttggatgttactgttatttgaagaaaatatttcctgaagtcatgggtgtggcatggatattggaatgaaggtgtatgtatgagtgtacacattcatggttttcttcattggctgcttttttcttttggttttttgagacagggtttctctgtgtagctttgaagcctgtcctggaactctctcttagacatgctggtctcaaactcactgagatctgcctttatctacctccagagtgctgggaattaaaggcatgtgtcacctccaattggccccttttccttttttaacttaattttatttttgcaatagggtctcattatgcagtcttggatgtcctggaactcaattttttttttttttgcaattcaggctggttttgaactcaagagatctgcctacctttgccttccatgagctaggattaaaggcatgcaccacaatgctcagccatatcttctgaggattgccaacttaaaaaaattcccttttgccgggtagtggtagagcatgccttatagtctagcacacgggaggcagaggcaggtggatatctgtgagtttgaggccagcctgatctacagaatgagttccaggacaagccagggctacacagagaaaccctgtctagaaccaaaaaaaattcttttcaaggtccaggcatagttgtgcaagacttcagcactcaggaagcagaggtagataggcctctatgattttgaggccatccaggatgatacagtgaggatcccccctctccttctcctcctcccaccaatttgtgtgtgtgtgtgtgtgtgtgtgtgtgtgtgtgtgtgtgtgtacgcgcgcacaaatgataggtactaggtacttaggaagttgaggcaggaggattgcaattcctaggtcagcataggtaatctagcaagacctggtttcgaaatcaattaaaatgggctgagggccaagtaaaaaaaaacaaacaaaggcttatgatgttagccttgtgctaattttttgtgtgtgtgtgctaatgtttgtatagcaggaggaaggtcctgttttcagtccttaaaggcagcacaaaataaattcaaaataattcttttgattgatgttttatgcttgtgattggtattgtcaaacaggttagatagattctttttttttaaataattatttaacttttattttatgtgcattggtgtgaaggttcagatccactggaactggagttacaaacagttgtgagctgccatgtgggtgctgggaattgaacctgggccctctggaagaacagacagtgctcataaccactgagccatctctccagccctagatagattctttatgttgctctcttttgttttgctttaatctcagggaactagaggtgttaacctatgttttaaaactcacatttggtagtgatacaaacagctgtcacactgcataattgtcacatcattatgttagtcactgtcgctcactaatctgtaggtataaatctgtattctaactacatgtgatcgggaaaaactagttactgaaagagtttatgctggatagaccatctgctctttatttccaaatccaaaatgaaaagttagccatagcatctgcaaatctgttaattaagatgtgtataggaaggtgagctgagtgaagtctaaagaggtaactttgactcatgtaagcactgtgtggaagtataaaatacgtagacattctctttatttaatggaaaggaatcttagtttccaagggcagttgtaacataaaacagtgttgggatgataaaacacacatgtgtggctagacctggggagtctgaagccagcctcagctatggctgtcaagcccccccccctttttttgttgttgttgttgtacctaccctgtgtctgtttcagtattattaactcatggcaggaggactagaggttgagacaggattttattgtgtggcctggactgactttgagctataggcagctgttccgtgttggcctcttgactgactgttggggtcataggcatgacccactgtgccagctcatcagttcattttcactcttgccatctagctatatcatcaactccttgaggctgggattataccttcatgttatccttagtgcttagtgcagcacttgggttatgctaagggatctttgtgctaggagtgacaatagtattttagagaaaaatttctattcaaattattgactcataagctaactttgtctctaaaaataaaattaaaatttagttgaaaagggccagtggctcatgcctgtctgtacttgggaagcagaagtaggtggatctattgagtttgagacttagtctatatactatgtttcaggccaatgagggctacacagtgaaaccctgctcctaataaataaatatttttataaaagaattaattgaagaacttgaagctaaaaaatcatgcatacaacaaaaaatgagcctagataaggttatagactgtgacacagactgcagaaggaccaactgctgtgtaggcagaacaactttgtcctaatgactaaattaaaacaactgacttcacagactagtaaagtagttgtgtcctagaataaagatagttagatagaaacataagcaaatgaaaatagtgatatattatgttggtgaaaattcacattctagacatgtttctccgtacaatagtagctaaatatgcttcaacatagaaaatgctttgatggagtgagtaatatggagaaatcctaagacagtttgtttgtttgtttgtttatttatttatttatttatttatttatgtttttgattatgttgtttttggtttttcaattcagggtttctctgtgtagccttggctgtcctgggacccactctgtagagcaggctgacctcgaattcacagagatccacctgtctctgcctcccaagtgctgtgattaaaggtgtgtgtgcaccaccacatatggctaagttttttctctttgtggtgaatcatgtaataaatatttttaaataattaatttttcaaaaagaataattacattgctctgtgttgtgtgcattccttaattgttgatattctttgtaattataattttcagtgcctttacagttagcattgacatgctgttccaccatttaaccattcatcagcggaataaattgaattttcccttgagctattttcttaaggataaattctcaaggatcaaggtcacacactctgagagaatgaatattttgctggcaaaggaatgtgtttgttttttttttttaagattttatttattatgtatacaatgttctgcctgcatgtatgcctgcaggccggaagagggcaccagatctcattatagatggttgtgagccaccgtgtggtttcggggaatcgaactcaggacctctggaagagcagacagggctcttaacctttgagccatctctccagccccgtggttttttgttttgttttgttttgtttttttaaaccctactaatttaatattggtaatttgaaatacgtttcattttgtttttttcttctgactatatcagtaattagacactggcagtaatagaacaaatcacagtatagatagtacataaaaagctttaacagcccaaactggaaatgggtgactgttttctttttaaaagtcaccatcccaatttattgtatttggcagagctgtggggactggcataggaaatagcgggaatcggcattaaaactttggctatggtaagtagaaagtttattttaggaaaaagattagctatagaagaaaagcataagtactgtatgatttgccttatgcattataggtttaattatttattttattttatttttgagacaggtttttctctatacttggctgtcctagaacttgctctgcagttcaggctggccttgaactcaagagatccacctgcctctgccttctgagtgctgcataatgttttcttttaaaaatgtttgtttttttgcattgtgtgtttttgtaggtcaaaggacaacctgcacgagttagttttctccttccatcgagtgggtaccaggaatcaaactcaaacatcaggcttggtggcaatctccttaacctgctcactaacccaagtgtaatcctttgtcctttgcatgtgtgtctaagagggtagctagctaattaatgaatatggtagttgacagggtacagaagaaccaccagtgtggttgcctgcagccctgtcagcattgtgattaatggttgttgtctctgttattgaaatggagaaaactgaggttcttgttgataattagttgctgcccaccaagtttgaggcccgcctgagctacatgagatcttctagctactctggagtctaaggtgggaggagttccttgaggccagcatctcttcagatttatgccttcttacttagatgtcatactccctgcttttgtttgttgacatcagctttaattatattttccttaagtggatctttatggaaaataccttggatatttccaagacaaaatttgaattgtgttacatgcaattcatttgaactcagtagctgatcggttttgatatttaaagccattaattctaactcacagatttctgttctcaagcaaatgagagatttcatgtctggatcttttgttacaaacattgcttctttttttttttttttttttttttttttttttttttgagacagggtttttctgtgttgctttggagactatcctggcacttgctctgtagaccagtctggcctcaaactcacagagatcctcctgcctctgcctcccaagtgctgggattaaaggcgtggtgatagctcagtgtgtaaagatgctgccatatctgatgataccaatttgcttgctccctgggtctcaaacagtggaaagaaagaacacacaggttgtcctccgacctcctcatgtgcatggagctgagatgataggtgtgtaatctcatactagttattagctatgcctagaaatcacatagagtcaaatgcataaagcttcatgggtttttgttgttttgccctggcttgctagagtttgaaggcatgtaagcaggacagtgagggtttgtggtttgtcttttgatttgatgtggtaatgattgcccatgtcctcttcccatttaacagacaatgctgtctttacattattgcagaaaactctatgtcagaagttctgactaggtgttggacagttggggggtatgtccagaagcttctcatcatggaaacctctaccagtcctgaacctgaagttctgttgtttgtttgtttttttttctccacccgaaaatagaaaccgtgtgttcttgggggcacagggactcactctctctctctctctctctctctctctctctctctctctctctctctctctgtgtgtgtgtgtgtgtgtgtgtcccacagggtttctctgtgtaatagtcctggaaccaggctggccttgaactcactgagatcacctgcctctgcctcccaggtgctggggttaaaggtgtgtatcaccaccacccctgcagggccttaatttttcaaacattaagggaccctacattggcaagctctttcagagtttgacaaataaatatgtataaaaagaaatgaatatttgtattatacaagctgactgaatatgataatgtgagttaaaactttttcttggagatgtagctcagaatgtctagcatacacagcccatttttccatacgacttaagccaaaccaaaataaagagcagtcacatgttcacatggactagagtttgggggccagatatgtgtcacaagccatgtagtgtatttatgttgttgttccattgtcatcgtcgtggtgccccccccccaatatatcctaggaaacaaaaaaaaaggtatttagatcccttgacaccggagttataggcagttgtgagctgcccattgtgggtgctatgaactgaactcaggtcctctaccagagtagcaagtgctcttaaccgctgagccatctctccagcccatttgtgaaggaacagggtacatatagccaggctggtctagaactcatcatgtagcaaggctgcccttgaaatcctggttttcaccaagcatgatggctaatgcctttaattccagcactcttgaggcagagtcagtgggagaaaagaactaacttatacatgtacccatgtacacattcatgcatgtatatgtacatgcatacactaaaataaatgttactttaaaaaaaatttagaggctggagagatggctcagcaattgatagcacttgatctcacaaagtgagagcaacttgggttcagttcccagcacctgcatgccggcttacaagttctgtaactccagttccagggaatctaccacccttttctgacatctataggcaccaggtacacacatggtacacacacatggtacacacacacacacacacacacacacacacacacacaggcaaaacactcacatattattattcaagaaattcagtgaggagcaggagccaggtactggcagatcccctatgacttcaaggccaacctgggttatgtagcaagttccaatccagccagagctacctgttaagaaactgtctcagagaacctaaataaataattaaagaaagagctagtggatgcagagacccaccaccaaacattagacagaaagagaaccctggtcggaggtctccatcgggtccttccctccctttggagctcagggaatcctggaggaagagggaaaggaggaattgtggaagccagagggattgaggatactggggaagcacggccttcaaaatcaactaagcagggctcatatgaaggcttacagacactgaagcagcaataatggggcctacactggtctgagctaggtcccatgcatgtgttatggctgttggcttggtgttttgtgggggtgactctgattctttgcctgcttttggaacccttttcctcctaatggggttgtcttggcagccttaatgttaaggctttgtgcctggtcttactgtatcttgtgctgtgtttgtttgatggtgctgggaggcctgctcttttctggcgtgagggggtggtggcgttagtaatgtatctggaagaggagaggaagggaatgctatggtcttgatgaattgtatgagagactaaataaaaattaaagaaatatctagaaagatggctcagtggttaagagcacatactgatttttcagaagacctaagtttggaccttccccccccatctccctccctctcttactccctccctgcactgtagatccaatcccagatccttacatataccgcacaagcatcctaccactgaaacacacctccaccccgccttcagacggggtcttgctgtataatacccaggctggtctagaactctggatcttctcctgcagccttctaagtgctagattacagaggcatgccaccttgcctaatgtatcttaattaagtgtaccattcattggtgttttttattcatattgttgcatagtcattatcaccaccatctccagaaccctttccatcttttaaaactgaaactgtttccattaagtggtaactctctcacagggctggagaaatggctcagtgtaagagcactgattgctcttcccatatgatctgggtttaattcccagcacccacatggcagctcacaagtgtctgtaattccagttctagagaatctggcaccctaatacagatacacatgcagacaaaacaccaatgcacgttaaaaaaagatgtaaatggtaactctccaacctggcctgttgactcctctagaaaccttataagtagaatcatagcatttggtttttgtgtctggcttatttcatgtagcacatcattacacttttctaatgtgttaaaatttccttcaaggctaattagtactgcattgtatatttgtatgtgccacattttcccctgggggtgtgctgtttggtgtttgagatagggtattacatagcccagcttgcctcaaacatggcatataatggaggctgacctagagctcttttttgttgttgagacagggtttctctgagtagtcctggctgtcctggaactcactgtatagagcttgctggcctcaaactcagatccgtctgcctctgcctcccgagtgctgagattaaaggcgtgcaccatcattgcctgcttggccttgaattcttgattttcctgcttctacatcgcaagccctaggtgtactgacaatgtaccattgcctgtctctgtttctatgttttagctgttgtgaacaatgctgttaatgggagtgactgtagtaatataaatatcttttcaagaggctgcctttcagtcaggtgacagataatttttaaagtgagaaaatactcatctgtcccaggtgttatatagctggttaatgatagagaaacaggctgtagctggacatggtagcattcctgtaatcccaggactcagcaagtggagacagttctaggggtcaccttgttatgtgtgagactctgtttccaaataaataaataataagacaattgggtccctaaagtgattttgaaaatctgtttctccttctcccctctgccacagaaggtctccagaatgcttagcaattctagataaaactgtttaaaagaccatgggtagtactccagtccctgcattctggaaactgaggaaggaagattgatgcacgctctaggtcagcctgggctacatagtatgttcagtactatcatgggatacatagtgaaaccttgtccagtctttcctcactaagccaaagtaaagagctgatgttttattataggaaccggaagaggccattaaaatgagttttaaattcatttaaacccattttagggcttaaatcagctagattggaaggggtcagatacgaatcagaatagttaggactagttgtcattcatggcagaggctacagtaccatcagtggaggagggatatgggataccttgtcaaatatttgggagttggacagcagacactatagtacagttgtgtcagtggctggtgcttgagagacgtgagttccatcttaagagagctattaattagtgttatgtaaagttgacagtgctctgtttcagacagacagacagacagacagacacacacacacgcacacgcacgcgcgcgcgcatgcgcgcgcgcatgcaaccaaagtgaggaggattgtatgtgactaagaagacaagaactaacttatttcatgatagtaccgggctgctctggaccctgactgtggtaataagtgttcagttaggatgttaatactaattatgttaaaagcttgagatcagttagactgtggcagaggtagcctctgagaaggcagggtatttgtcatttctcatcatgtgaaaaatattaccttggtggagacttgaaacagatggtgtacagttggagtagactctgttattccaaataaacatttgctggaactggggtacagcaatccatatttcacttttccctatttacattatcaggtcagctgtgttgctgctgcttttactagcatgaaggttatcaacaggctttgatgttggcaggctgattacaacatgtctttaaatattaaaatgattagcactggaagaaaccctttagttacctactttctatactcagtggcataatggctattagcactaggtaacagcgtgtgtgtgtgtgtgtgtgtgtgtgtgtgtgtctgtgtctgtgtctgtgtctgtgtctgtgtctgtgtgtggtctcactggaatgatttgtctcaggttctgttgtatttaatcagcattagaaccaggcttcaggcacatctttcagattcaagatcagtgttgtcttccacaggaaaaaaaaatgtgtatggttttgatctcatgtatgtagtccattatagctcagacacccattgtagttgaagacctcgaacttgtaattctatgtgtgtacttgtatgttagatgaggtttctactgagctacatccctgtgcctttacatggttttctcagatacctaaatatattaatttccacttgcattgtagccagactggcctggataggaagtctgagctttggattaaagactgtcagctgatcaggtggagggtgacatgaaatgccaagggctgtcattagctactctccatccatcaaaaagacaactaatatcatggtcctcaagggggatggaggctggagctagctcagcttagatgcattgagaaagagctggttatgactgccaaacatccaccaactcccatttgcagcctggtgagtggggtgggcttcaggaggcgtggtctggctccactcacttcaaaactgagtattgctgtcccaccatggttattcctgggcagcttggtatggacaacagccatggctgccacagaattccgccggtctcaggagaacctgagggctggcagctcctaaaccaagtggcctcatgctggtaactggcaaacctgcaagcctctttggtatatagaacaaaaaaaaaaaaaaaaatttggaacacagataatttttgaagcttgagagcaggtattttggatgaagtgagtcaagaataggtctgaggactgagctccaggattctaaatttaagatgacaaagaagatgctaaaagaagtgcatgaaaatagcagccagggatatggggatgggggttgggcaccacacacgaaaaccaagtcaacagtatcctttgctggcctataagcaccggaagtgtaaactgtagaaaccaccactactctgaatgctagctgtttacagtatcataagggtcaggcacattagtaatacataccttcttaaaatttctgtgtaattctacccagccgtctccaggcagatgagactttttctggtctcgggtttttctagaaaagtggaggtggagcagagcctggaaataggcttaatccattgcttaactggttgctcttccagaatttctgagttcagtacccagcactgacatgatggatcataatagtcctctcttctggtgtgcagatggcagataaaatacccatatccataatcaaacctttttaaaaaataatttattttagaggcagttcactctgagttccaggccagccagagatacatagtgagactgtctgaaaatacactacactcctcattttatgtgagtgtggaggttacagaatgtattttctctttgtaccaggtgggttccaggagttgaactcagaccaccaggcttaagacacagcagtaaaacgtatttactttagaatttattgtatttgtgtaatatatacatgtaaatgtatttatgtgtgtgtgagtgttcacatgggacatccaaagtcctttattttattcctttgggacagggggtctcaccaaacctggaaccaggatagtggccagcaaccagtgatcctcctgtctctattcccccacagctcctcctgtttctttctgtttccccacactcctattactaactttcacccgttgctcttccatgtaaaggcacagggaaatgctggctgtaattcacagagaaggtcccagaagacacactcccccacactcaaacttgcagcctccagagttggtagaagtctctgttgcttaaaggctccaggttgtgtggcacttggttatgagcaagctaattgagcagaaagcattcccgtgaaaccggttatgttctttttccagtctgggaaagtgacatcttgttcctttttctttttctttttttttaaattttatttatttgcttatatgtttatttattgagacagggtttctctctgcaacagccctgtaaagttatgcgctactatcacacctggcctttcctttaaaaagagatttattgttgctgggagttggtggtgcacgcctttaatcccagcactcaggaggcagaggtaggcggatctctgagttcgaggccagcctggtctccagagtgagtgccaggataggctccaaagttacacagagaaaccctgtctcaaaaaacgaggagggggggtacatgttagtgtgggcactttgagtgtacttggtgcctgagaaagctaaaagagtagatcatatcccccgaaactcgagttagagaggattgtaagccaccatgtgggggctgagaattgaacttgggacccctaaaagaacagcaagcactcttaactggtgagctatctccccagcctctacacccccctttccccctctccctttcctgtcttattctttccttgtgaatttgttgtcttaaaggggctttggtttagagctctggttctcaaccttgctaatgttgagatgctttaatacagttcccatgttgtggtgacctcagccataaaattatttcattattacttgataactgtaattttgctactgtaatgaatggtaatgtaaatatctaatatgcaggacatctgataagcaacccccaaatgagttgcaactcacaggttgagaactactagtttagcttgaaaatatgactggaggtagttaagtgtgagtttccagaattaggagctggaaatgacagcaaagacatgtaaagccaagttttccatgggacaattatgaacaaatttcagaacttgcaaaatgattaaatctgggtgtttgtgaacatgttatttttcatctttggctttgtgacttacccaaagtaggcttgaaaaagacaatttgtgtaaatagttaaagctttctaaagggtacttagtatataatacttaccagctattttccactgatcataaagtaaaagcaggaacaaaacaacaacaacaaaaacagaagaagctgggtgtaacagtacataccttgctatatcagcgctcaggcctgcctgttttgtttttgtttttttgttgttttaatcagatctgaggctgtaactcagcaggaggatcagaagttgaaggcttcctctgttagatagtatgctctaggccagtctggactcacaggatgtacactcgtgttctctctctctctctctctctctctctctctctctctctctctctctctctctcaaaaaaaaaaattaaaattaaatgggtctgaaggacatggctcagtaaagttaagagtacatactgctcttgcgacaatcacagttcagttccacggcctctgatacctatggcttctacgggcagaggagcacatacctgcacatacagacgtgtaaaacaataaataaattctctaaaaataataagttattgccaggcgttggtggcacactcctttaatcccagcactcaggaggcagaggcaggcagatctgtgcgagtttgaggccagcctggtctccagagcgagtgccaggataggctccaaagctacacagagaaaccctgtctcgaaaaaccaaaaaaaaaaaaaaaaaaagttatttcttttatatacttgatttcttcatttttatgctagtaacttccagttataaactgaagtgttcttttatttccaaacttctgaattgaactacctactaggaacatatattggtttagagtcagcacaaaacttattgtcctgcaggtggagtggtgtacactttcaatcctagcactcaggaggcagagacagatggatttctgtgagttccagaccagcctggtctacagagtaagtcccaggacagccaaagctacatagtgagaccctgtctccaaaaaccaaaacattaatgtccaagtttcctctcctcaaatatactctaccactagtgttctctatcctggtcagtaacccattccactttggtgtgcatcctcaccccccgtcgtcttatcaacaaccagatcctctgcatcctaattttagtgtcttgtttgtttgtttttgtttttttgaagcagcgtttctctgtgtagctttggagcctgtcctggaactagctcttgtagaccaggctggtctcgaactcacagagttcgtatgctaccactgcccggctcttaagtttcttaaatccactctctcattccattcttactgctttttcaggaaatattgtatgtcacaacaggaaaactcacacataaccattttgcatcacagtctcatcatttccccatcaaaaacagtgatctcttcttttcctttcttttatatttcctcccaccctctccccaagtaatttttagagtaatttattaatatagatagatagatagatagatagatagatagatagatagatagatagatagatacagatagatagatatagatatacttgcatgcatgtatgtgtgtgcattgcatgcctggtgttcatggagtttagaagaggttgtcagatgctctggaagtacagtttcagatgcaatcatgtcgttgctggaaccaaaccctggttaacaacaattgctgttgttaactgtcttaactgcagagacagctttccagctcctatttatttttattgtatgtatataggttttgcttgtgtgtatgtttgtggaccacatgtgtgttttatgcctgtgaagccaaaaaagtgcatcggattccctggaactggagttaaagacagttgtaagtcaccatgtgggttctgggaattcaaacccaggtcctctggaaaagcagctgtgttcttaacctctaagccatctctctagttcctgtctttgattttcatagctttccttctaggtgatttttaatgtcactcatttacttgtgttgaaaaacaaggccttgaagggtgaaattatttgctaaattttatgtaggtcgtaagtaacaaggatgcatcaaactagccctttcactctgcatatctttattactgtttgaaactaggaattaacagtaatggtgctggtttatgggcagtggattaaacaaggagtgagtaatgtggtctgtgaactgtgttcctgaggcagattttatccactagctaagttttcaggaggtgaagcatggagctcagtgttttggagttgggctgacgcgtctttgttaccctggccaagtgcttgaatgttaaaactcatctatttgactgctaagccctctagcctttggcacccttgctgtaaagacaggtggtctgagaaaaaatgccctccagattgatgcacactatacataacataacagtgcgagacaactgtcagttccttcctactcttctccctcaccccctccagaaagctgggccccagatggaagagctggaaatgcgtcaactgttctctgaagggcattgagaaaacactggcaggaagaaaaaggcaagcgcaacagctcattagcccactaatcagataggacgaccatcattttcacaaagaaagcatcctgaccagggacagcaagagtgtgaaattttagcctcatggtttacagaatactgtaggttttgttagggggtttgtaacatgggtgcttgacttccttgacactttttattcatatatccctctctgaaatagagccactgcaaaatggaacataaaatagtatttggggacatctttcctatcacaaagtgtggtgaatatgctaagatgtgccttgtggtttatatgaacatgctggaatatgccatctttataactgatcctacaagaaagctttgattctaccttctcatttaaaccttttttgtggtctttgtacttgaaatcaaaatcagttgctactacagtatttaagttaaaaaaaaaaaaaaaacaacccatacaataggaattagtgagaggcatatagttcagtttaaaggtgagcctgttagccaggtactaataggttctcttttgtgagaaataatttattttaaatattttttgagtcatggttttgccacatttgatccagaatgttttatagctagagtgtggctttgagcttctgatcttcctgtttctaccaccctggtgctgggattacagccactgtgccaggttttatttatttataatttttagatttttcttatgtgtgtgttttgcctccatgtatgagaggccagaagaagctatgagattgcttagagctggtgttagagctggttgtgagctaggaactggacctctgtcttcttcaacctctgagctgtttctccgcccctcttacatttttttcatgtgcattggtattttgcttgcatttgtgtttggggggtggtgtcgtatcctctggaactggagttatagatagttgtgagctgccatgtggttgctgggaattgaacccaagctctctggaagagtagccagtgctcttaactgctgagccatctctccagcctccctctccccaatcttaaaaggtcctttccaagccctgcaaggtgtttactgccaagcctgaaaacctgaatttgatcacccggaccaacatgatagaaggagaaaactgactcaggcaagtttatcttctgactgccacacacatatcatagtgtggcgtatgtgggcatgcgcgcacgcgtgcacgcgcacgcacacacgcgcgcgcgcgcgcacacacacacacacacacacacacacacacacacacacacacacacacacacacacacaccaaatcaataaatatgtaattagatttttaaaaggtcctttccccaaataaagtagtattgccgagctagatgttaggacatgaacatatctccaggcagctaatgttttaccctttgttgtaagtatcatcttaatctctgagtcctctaggaaaataggttcagttccgattgctgttgctatttattatttatagagagctttgacctcctttattttattttattttattttatttttattctttgcagttggttgtgagaaaagggtgccagcaatgcctggatcgcctgtggaagtgaagatacagtcaagatcctcacctcccatcatgccacccctcccaccaataaatcctggaggaccgaggccagtgtcctttactcctacagcatgtgagacctttaaattgaattcctgattcagggtcataatgtagatttgagtaactggcttacattaaaccttcaatatacatcattcaacatgactaaaatataaataagggtatagtgatgcattcctataatctcagcctgtaatcccaggactcagaggatcaagagctctaggtcaccctttggtgtgacacatgcctttaatcccggcatgtgagaggcagaaacaagtggctctcagtgatttttgaggccagtctgatctatatagtgagttccaggccagctgagctacttagtgagggggctatttcaatatgactcccaacaatatataaagattggcatggtttttatttctttgtgacagagtctcactcactatggagctggatatattataatttgaagagtgtgaaaatagatcacacaatttaattttaaaaggctgtaaaagtttatctgtattgtccggtggctgcaagcatagtaatattctggtttttttgtggggtgcttcaaagagggcagctctgatcaggatagatctttctgtggaaacaaagatgaaagatggttgcagctaattttctagattggtgaaattaagtgttgagctattttttctgggaggttttagtaatctctttgactggaagatagaattaccctcccttcttcctcagcccattagtttttttatgaattcaacaccattttcctgaaaacctactgcctgttaggggatgatgaacaaagcaagagaatatagatgagatagctcagcaggtgaaggtgcctgttaccaagactgacaacctgagtttgctcctcaggaaccatgtggtaggaggagagaaccagctcctgtgagttatcttctgacctccacattcactgacatacacacacttgagttcacatgcacaccaaataaatgcattggtggtttacaaaaatctagtaatgtttatgtgttaaggtaatatcctttgagcagtctcacctggtgtggtgacatacacttgaaatgcttgagggaaaagggaagtagaagtctgaggcagaaagaactctagttcaaggtctgtctcagaaagcaaaaaccaaacagaaagaagaccagtctagcaagtaattgcataggtacaaagaaaagaagtaaaatagtggttgtgtgtgtgcacatttctggaactcattctgtagaccagactggcctcaaactcagagatctaccttcctctgcccctgagttttgggattaaaggtatacacaactacacccagcacaaatttattaaatccattagggtttaccttgaagaaggcgtagaggtggagaagggaagtataactgagtgtatgctggtcttcatactcatgaatggcggttttattagctaagtagtggttaaaagattgttgttttaaaacagagctaatgtcttgactttaattattttctgtactttgttgcttgcttgcttgatttttgtttgttttggtgtgtggtctcatgtagctcagagtggtcttgaactctttacaatccagcatgatcttgaactcttgatgtttctgcctccactttccaagtgccagtgagatcatgggaataggcccccatgccccactttgtttttttaagataggatctaactctgtagctcagactggcttccaaactagaatcctcttaacttgtctcctgagtgctggtggcatcactggtgtgagcccactacacctgccgtatttgtttatttgataaccctcccctctggacagggtctcactttgtaaccctgactatcacggaattcactatgtagactagcctggcatctaactcaacagatatgtgccaccatgctggcccttaacttgattagatttttaagcatggatatgattaggtcaaatcggattgaaacttaggtgctaggtaatcttgttttactattcagtcacagaggagacttctttttatatgtataggtgttttgcttgagtgaatgtttgtacacacttgcatgccctcagatcccctgcaactggagttacatacagtagtaagcagctgagtgtgtgctggttaccacacctgagtcctctggaagagcagccagtgcttttaacccctgagtcacctctccagctctcataggagaattttttccttaatgccactgagaatgtggctttagaaacaaagtatataagccaggtggtggcagcgtatgcctttgatcttagcacttggtaggtagaggcaggtggatctccatggtctgaggccagcctggtctacagagctacacagagaaatcctgtctcataaaaaccaaatgtgtgtgtgtgtgtgtggtccagtcctgaggtttcctacattaaaactaccaagaagtaactactgataatagcaaaaaaacagaaatactgattgttttatcatcatttgttcaaaaataaaggatgggaggtcctttatggagtttaaatagtgccctttcccccttttcttcttttgggtatatggggtcttgatacaccgatgcactggtttcaactttttgggcctaagtcactcttctgccttaacctctagaatagctaagatcactctagttttagaaggtatttttctgaatgatcaagacttttgcattatttgtcgatctgtgtcaagataagaggaaagctactctaaaggacattagtattttgaatggccaaagagagacattttgatgcagaattaggtcataaagatagacccttaaaatatctttgacgttagtataattctgtttttctggtatttctcacatactaacttgtgactgattgcttggcttcattgagattttcagaaggatatttgtaaaatgaacagaaagcttgatgtgtggtgggtcacacctatattaatagtattctggaggccaatgcaggagtatcgtagcaagttcaaggctactgtgcaagaccctatctaaaaaggaaagaaggaaggaaagaaagaaaggggtctctgagaaagatgactcaggagttaagggcactttttagtcttgcagaggacaggagtttgttttccagcactcacatggcagctaacaactgtctgttaactccagttacaagatctgtcttctgatccccatgggcatcaggcatacaagtggtacatagacatacatgcaggcaagacattcattcacacaaaaattagattttttttttaaagattttatttatttattatgtatacaacattctgcttccatgtatatctgcccaccagaagagggcaccagatctcataatggatggttgtgggccaccatgtggttgctgggaattgaactcaggacctctggaagagcagccggtgctcttaacctctgagccatctctccagcccccaaaaaattaagatcttaaagggaaaaaaaaaataaaaatatgagtttcagttagtctccaactcaccttaagcaccatggtgtctatagttaaatgttccttctgtacctttttttttccccccagaaggggctcacagtagccaggtgttctagaactcaatatcctccctcacccaaatgctgggattatgtgtgggcatcactgtagcttgctttttcctattcatagtgctccacgttgattgtgtgtgttgtgtctgcttgtttactttgtaaataatgttcttatttagtccttaagaatttccttcaatatatttttggtcatattcaactccctccccaattcctctcagatcccccccagctattcaactttatctcctcccaccccatctctctctttctctcttgtttcacactgttctctttttccctttccctcccccttccagtccagtttgtgatgactgactacttctgggtgtgggacctccctggagtgtggtttggatacactaggtattcctacattgaggaaaactaactgtcagcaagaaaactaacagcaagaatcatatgttgccaggcatggtggctaatgcctttaaatcccagcaatcaggagacagaggcaggggatctctatgagttctaggccagtctcatctacaaattgagttccaggacatctagggctgctgttacacagagaaaccctgtctgaaaaaataaccaaaacacacaacaacaacaacaaaaaccacaaccaacacacacacacacacacacacacacacacacacacacacacacacagaatcaaatgccaatagctacttggtggtggtgggactttgtgcccatctctcctctcttctatgcttaaattttgtctggcttgaacctgtgcttgcattcacaatctctataagtcaatatgtgcatctaccttactatatgtgagaaacagtttccttgaagacatccaccatctctggattttatagtctttctcttagatccctaagtcatgaggggaggagtataataataatagacaccatgtttagggttgagtattctgaagtctttttctctgcatgttgaccagtgttgggtttctgtggctatctgctacatgaagaagcttctctgatgaatgttgagtgatgcatttatctatgcatatggaaataaatcattagtaattttattgctatgcccatttaacaaataacagcaggttttctcttaggtctcatgacctgtctagccatagtttctggccccattgacaatatcacatacaggttctgtcttatggagcaggcctgaagtccattcaaaaagtgttgggttactcctatgatatttatgccaagcaggtctttattgtagctcacaagagttctgggttcaaggttgatgacttattttttttttcctccagtagcatgcatagcacccttttagtactctgaacactagccagtagagatgaagcttctggttaagtataagctagattttcccatatttgatgactcttgattggtgtctccatcagtagagtattacagacaagttctggagggtaacaaatagcattggcaaagcctttaatgtttgggcttggggtggtctctgtaactccattatccaacagctcaaaaagaggttacccagttttctttggtagtggcagctatgtagttggggtcttgttcccccatcatagagcatctctctctctctctctctctctctctgtgtgtgtgtgtgtgtgtgtgtgtgtgtgtgtgtgtgtgtgtgtcttctaaaatagtttgtgtgaccttttcaaaatgcccttaatgttagttatccttcccatgttccttctctaccctctcttcccatttcccaccccacttatgtacttagcacttatttacttgcttgctttaaatggaatgtcactgggtcactaaggctagcctcttattcctgggtatataagatctttccattgcagcccccccacccagtagccataactacaacacaagcacatatcaccatacttagattttaatacctgtacaatattctgttgccatttttcctgatagtttgtcttagtatgcagcagtctctctctctctttctttcttccttccttccttccttccttccttccttccttccttccttccttcctttctttctttctttttagatagtttctctgtgtaacttttgaagcctgtcctggaacttgttctgtagatctggttggcctccaactcacaaagatccacctgcctctgcctcccaagtgctgggattaaaggcatgtgccaccactgcctagctggtacacagcaatctcattgagggtggaaatgagtgtgagtgtgtgtgtgtgtgtgtgtgtgtgtgtgtgtgtgtgtgtgtgtgtgtgtgtgtgtgtgtatccagagagaaagtgagacagacagacagacagacagacagacagacagacagacacacacacaaacacaaacacacacacacacacacacataaataaatgctttacagaattcaaaagagtagtgaaagagactatatgtataagtcaataaagactcttacattctatactgagtcttctgattctggctttcttttagtaagcaatggcatcaaccattcccctcctaccctgaatggcgccccatcaccaccacagagattcagcaatggtcctgcctcttctacatcatctgcactaacaaatcaacagttgccagctacttgtggtgctcggcagctcagcaagttgaaacgctttctcactactctgcaacagtttggaaatgacatctcacctgagattggagagaaggttcggactcttgttctagcactggtggtaagtatggcttcaccttcgccagctgcctaagaagttgtgatatattcctgttcattcccaaaccatgtagatattctggactacactagttgtttcacaatttttttttaaaactgtcaaattatagatttcatagcagtatttatttgtcaaagaatctataatgtgtcttattatctaaggtgcggatttaattccagtgagcggctttggatttgtcttaaacagctttcagcaggcctgctgaagtccaaccgagttaatagaaggttgtttgtatgtcaacataatttagtaactagtgcaaaccagttttaattttcaaaacaatattttgtaaaattagaagtttaatggtctaaataagtagtttctatacagttatgttgttcagctccatgtgcatagttttagtttttctttctatactaatcatactgagcctgcttataaaggattaactttctatgttgccatctgggtgagattgagtcttctcaatttatgagggaagtgctgccagttgtcagtgtttccagatgaaatactgtaagattcactcctggtgaaagcattgtattctttcccacatgttaatttatgtttatgatgagaagctgagttattgtagtagtccttacagttgcattttctctcaaaatataatttaggaaaatccctggggttctccagtatactggatggcagggtatggaacacacttggtggagtgcttttctagtgtccacagccctgggtacagtcccagtattctgaatatctatgcagaaagactagacgttcaaaattatcctgagttttacatagtttcagtctagcaagtcagtgtataagatactgtctcttaaccaaatacttaaaagaaatctcctgtaggtcagtggtcttgaactctgtgtagtctaggacctcaaactcttgatcgcctgcccctgcctcattagtgtaaagattttaggcatgaactaccattattttgttctactgctttattgtaccacagtttatacatttttgcttctgataacatttgaattgtttgcatttggggcattgtgtcaggagtccctaatactgccgtgcatttgtagattggtttaccctttccagatttgacatatggtggtgctcacagctaacatctattccagaaaagtcataaaaatacacaggcagattgtaaaggagatacacatgggcagagtctggaggagtctgtgtgctggcctccttaatgttctccccatttcatgattacacagaacacactttccccaaaacaaagaaaatgtgtgcagtgcttctgcccaaagagtcctgtaaagatgctgattgttgctggatcttgttgaccatctatgtctatcttctcctatatggaatccaatgctttagcataaccagaaacagtaacagtgagccctttctactacttggagaaagtgtgaggtttttttttctgtgcatttatttatttagagcaaatctacttattagtcaaaatttaaactatgataggttagcattattaaattgagactaagttagctttttttttcaagacagggtttatctgtggctttggagcctatcctggaactagctcttgtagaccaggctggtcttgaactcacagagatccacctgcctctgcctctcgagtgctgggattaaaggcatgagtcaccaacgcccggcccaagttagctttttgttaagcttattttttgttgtatgagtgttttgcttgtatatatgtatggacaccatgtgtgtgcagtctcagaggatgccagaaagcatgtgtgttgggtcctttggaactgcagttacagaccattgtaaggtgccatatgggcactaggaattgaattcaggtcctctggaagagcagccagtactcataacattgagccatctcttcagctccaagatgtatttatttttattttatatgtgtgggtgtttcacctgcatgcgtgtttgtgcaccacagtgtgtagtgctcaaagaaccagaagtgttgtatcctcaggatctcttgcttgtgtttagtttgtcttcctcagcccagagccttaccagctctcacttgctctggtgctgtgtctatggcgcttagcggttgtgagagcccgttttatcacttttcggtttatagtgcagtatgttgtcattgttatgccatcgctgtcaccattactaccactgccattcatcatcagaactatttttatctatttggtttttctagattatgtttcatgtagccccagctaaattcactgtgtagctgaagacgatttatttatttatttgtttgtttgtttgtttgtttgtttgtttatggcttttcaggacagggtttctctatgtaacagcccttgctgtcctggaactcactctgtagacccaggctggcctcaaactcactgagatccgcctgcttctgcctcccaagtgctgggattaaagaccaccaccgtcccactgaagatgacttttaaatatttatttttctgcctctacctttccagtactggaattattatcatgtgccaccatgttcagcttatgtattacctaggggtcatattcaggtcttcatgtatgccaggcaaacactgtgctgacaaagctacaccccagacctttacatgattcaacaatgatgtaacgagtgtgattgttttgtttttgttttaagtcaatgtttatctgtgtaacagtcctggttgtcctagaactcaatttgtagaccaggctggccttgaactcacagagatcccctgcctctgagtgctgagattaaaggtaccactccaggttgaaaataaatgtttttaaaggataaggcatattctattatctgtgtgtacatttagtttacccatttgtcctgtatgaggaacactgggttgttgctcctgccttttcagttagggaaatttttatatcattttacaagttttgctatccacattctcagatcagctaatagtccacactttcgtgaaggcctggcttttcttttcccttttctttctatatattttttattgttttaatttttatttagtgtatgcatggtgtgttccagggttctggtgccctcttctggcctccacaggcaccaaacatgttacatgtacatacatgtagtcaaaactcatacacattaaagaacaataaatcttttttggtttacactgtatcagtgtgagtttcatgagatgttaacagtgaagatgagagaaacggcccattgcatgtaacctttctaagtttttaagtttttttttttttttaaagcttaaaaacgttacaattttatgtgaatgagtgctttgcctccttgtaggtctgtgtacatgtcaaaccagtatgcttaactgcttagccatctctccatcccttctaatttgtttttgcaactttgttagactaatttatctcaaagaatgtaaagctatgtatagttttgtcaataactccatcactcagtaagctgttctagaccagccttagtgccatagaaaaagcctatcccaccaaacaaagtgtgggggactatctctgtccttgtactttaatcttctaagtccattatagatgttcccctgagactaaatctaccaatatcctaccctttgaattttctgtctcccaaaaataaccatttctgagcctttaaaaaaattattacatgcagagcctgatgtagtaatgtatacctttaatctttgcactctggaggcagagtcagatggatctcttgagtttaacccagacaatgctacatagtgaggccgtctcaaaaatcaaaacaaacagataaaagaattacatctatctaatgtaagtgtgtgtgttacactcatgccactgtaaatgcatggaagttagaggacaactgcaggagatggaactctgatttacccattgagtcatcttactattaaaaataaaaataaactttctagtatgctttcctgctggactgtgcattctttagagagggagaaaaactaagctaaacaagaattaaatagttaagctctttgtgatttaacagttgactgaagacagtctggtatggcaactcatttctctgagatccagtctgccctattttgtctaaacatgcagcagccttgggtctgttcctgtggcatgagtcatttattctgtgctacaaatctgtattatcactttgtccatccatagggaaattttagatcattcttttggtctttccatatatgtaatctattttgctgctgtgcccagttttggatgttgaacattatttgtcttttcagaattcaacagtgacaattgaagagttccattgcaagctccaagaggctacaaactttcctcttcgtccatttgtgattccatttctcaaggtaattctgagaggcattcattgtaatttatcaacagcatctcctcaaaatctgctggtccctgctctgtgtgatctcagggcctcttactgtagttcactgtctttgttgtatttggggctagtaggtaaacagtatctacatcagcctcaaacatgatgagaattgcagtgctttgagtgatttctgtttgcaagcactataatcagcatacaggagcaagtgaaggaataaagagggaagaaaatgaagaaatcccactaagtctttggagtgtggtctgaagatgaaaaatatgtgttatctgagtggagaacctttgcaaagagaggcttatgcagttgtgtcaggatggtgtgagaaggcagtgcttgtttttcctcaaaccccagataatgcagtctaattaatgtcctctagaattattgtttctaaattatggttctaaattaccatcttactttcttaaaagtgttttcattttgaagtaatttcatgctcgtagatgagctgtaagagggtacagtaagctttccttatggtctcaaaccagttttccaaacagtagcacttcataatcatttcctatctttcttctgaaaaacaacccccccccccccatgggggttctctgtagctttggaggctgtcctggaactcgctttatagaccaggctggcctcgaactcacagagatccgccttcctctgcttccccggtgctgggatcaaaaccttgtgccaccaacgcccagcttcttctgaattttttaaaaaagaagctgtagatgtgatacatctaaatttccaaatctagaattttcttttcttgctactagggatccaactttgggcttgaagtatgccaaacaagtgctctttcaaggagttgtgtccagagtccttaaatcaagacgttaacatttacataacacttggtgtttaatgtacagaccttatttatgttttactagtctcccaataatcttctttatacaaaattaagcctttatgtgtgtgtggtttaataaattaatgtatgagggccttccttcccataatcattcaagactaaagactgaggaaaattctaaaatcttcaacctgtggcttactagatgattgagcacaaattcagttaactgatggctgagaggtgagatacagggagagagctagagagaatgcttgcataaagggttttgaaggagtcaggattggcctgggattggcatctgtccctgtctatgactcgctgtgtctctatgtcttcattgtccaggactcagtcacatggtatcacctaattacagcagaggatagaaaatctaggctagatgctaggagaaaagagcttgttacatggctcatcagtttctgctgcagatgctattgagggctgtttcttttcctcttgtctactggtcttctctcacacaactgaggtaggtatggggaggcccttaagacctcccactgtggaaataccttcttgtgcatcccactggtctagtctgtgcctttgctcttgctttttctactctgctaatatatgtagtatctgaaaagggcttgagggacaagtagtcactgataaggagcataacgaaaaaatgtgacatggcaccaaaacacacaaattgggggttcttgtctgcccagagcaccagtcctatcatgataggtagttcctgcacttgatgccctgaaagagtagagcttttgtgtgaaatacttggtactaaatgcttctttctgacatctcagaaatggagagagaaatacattcagaaagacttgttttgttttgttttgtttttgtgttttgttttttagaacatggtttcactgtgtatcccaggctgtcctagaactcactctgtagcccaggctggccttgaactcacagagatccaccctcctctgccttccgagtgctaggattaaaggtgtgtgccaccatggctctgcttctttagtgactgtggggcacaaggtctgggtctatatttaatcatggtccctcatggcatgtagtattaatttgtaacagtttctcaacttttaatgagtattatagctttgaataattttatttttaatcatgtgtatgagtgtctggtatatatgtacatgtgattgttgggtgcctgtggaggccagaggagggtgttggatcccctggactaggtgctgggaatttaacttgagtcctcatcaagaacagtgttctttaagtgtgagccatctttccagccacaagagtgtcatgatttagaggatgctgattgtaaagaagctcagcttgcgttgttctggaactttctctctttgaagcttaaagtcatttgatatattttagttaagaattgcaggtaagctgggcagtggtggtgcacacctttaatcccagcactggggaggcagagtcaggcggatttctgtgagtttgaatccagtctggtctataagagctagttccaggacagcctccaaagccacagagaagccctgtctcgaaaaacaaaaaagaagtgcaggtagtttagggtatggtgttacatgcctataatcctggcatccaagaggcgcaggggcaggagtactgcccctcctagttcaaggccaacctggtctatgtagcaaattcctggctaactaatagtacatagcaagatcatctaaaaaaacaaaaacaaaaaaaaatcaacaacaacaaaaacaaaccaaaaagacaatatatttgtataaataattatcataactttaaaaaagggaaaaaaagaaaattgcaggaagtggtaaccctgcagggtggcccaggacataggcagtgattggttccatcatagataatgtcttttctcccccttaacaatttagcaaaactgattttctgccttgacttttttctataaaattaatatctcctctgattaaatgattgttttcccacatggcatgctaacacaagactgcagtcctagtaattgagaggcttcaggtagaaggatcacaaatagtagatcagtctgggctaaagaggtcctttctcagaaaaaaacaaaaaacaaaacaacaacaacaacaaaaaaaaacaacagaaaagtactactaggacctggaatttagctcagtgatagaaaacctacctgtcatacacaaggccctgagtaaattactaccagtttaaaacaattaatagtaaagattactttcccatatgggaactgttagcacatgcctttagttccagcactctggagacagagaggcaggtgaatctttgtgagttcaaggccagcctggtctacagagtgaccaggacagttccagaacagccagggctgcacaaagaaacctgtcctgaaaaacaaaacaacagcaaaaagattattttttccctaataggtaacatgaacatgtatcagatatttcattgagttgatgaaggcatctgtgagacttcacagtcattattgcttaataaataatattcataggtcacaattaatattttttaaaatatttttaatggtgtgtgtgtgtgtgtgtgtgtgtgtgtgtgtgtgtgtaaatatgcacttgagtgcaggtgctgtccagataccagaagcagtgttctgtgttgtggaactggagtttcaggcactttggcaatctgaccctgttcccctgtaataacagcaaatacctttagctgtggagccatctctctagctccacagttcacagttacagataatgactgtgtaaacacagaactcattctaataagtggcactttccagaaacaattcatgtgaaatataacagttgttttacttctgtcagctatttttaagtcactcacagaatagctcaaaagaaatgaaagattagaattttgttgtcaactagtttgaacaaatctagcataccatttggttttgtaacactgagaatgctgtatacagataaacatttgcagttgacttaatgctgaggaatacccacttgaaatttaattaaactaaatattacccccttctccctgaaaaaaaccttactgttactttcattagtagatttgtactacaaaatttactatgttcaattaacatattttggattttatttttccacctatgagataaatccttacaattaattcttggtggctgaaagtactgtatgacctttgtcagccctggagtagctatgctgcttggaccctggttgtctttgtcttgtcttgtcttgtctgggcttttttttttttttttttttttttttttgtttttttttttttttttttttttttttgttgttttatattgcacagggttttagccctggatgtcctggaactcaatctgtagactaggcaggcctcaaactcacagaaatccatctgcctctgcctgtcaagtgctgggaataaaggcatgtgccgccaccacctaggttgtcttttctttatatctgaatttacagacaactattcaccgagaccctacaattaaaaaaacagtttatgaaatttgtgttaacagaacataattaactatgtttttcctgtatgtcaccaaaggacacacgtcacaaatataatgatttgacatgtttcctttttttaattaagtttttgcagttgtaagattgcgattctagaccagacttaagaagtgtttcatattgtcagattctctattcttaactgtgttatttggaaaacagcatgaggtaggttgttgcagcagctttttggctagcatttgaggttttgtcaatttatttctgctttaaaacagctactaattatggtgcctgctcagtgagggggtgactacttgcatgtattaaaactttttatttactcatttgtcccttgaggtaaaggcattcattataggcccctccctgaattttagggaaaaaacatacaactttttgatatatatatatatatatctgaagtttgtgggtttgtttgctttttatcctttgtttatttttattttattgcattggtgtttgcatgtatttctgtgtgaaagcgtcagatcttggagttacatacagttattagctaatatgtgggtgctggggattgaatctgggtcctctggaagagcaatcagtgctcttaacctctgagccatctcttcagcctgttttgttttgttttgttttttgttttgtttttttatctaccaaaagttttctaagtatgagaaggaaaaatagcagaacataaatttccttttccagattacattattcccagcactcctcttcaaaactgcatttccagagtaatcctggtttccaggattccaagatctctccagagagccctcagagaaggttgagtgccaccatcagagagtggttgtgattcagaagaaataaaccagagcttgtaattctccattttaggcagtagtaattctcttaactggccagtcttcaagaaaatgtgtgtgtattttgggtgctggatatgcagtttagtaatagagtgtttgtcgtgtctccatttggtcctaatcctattgcccagacttttgaaaatatatattttatggctggaaaggcaacccagtggttaagagcgcttgttgcgttttcagagaacctaagtatgatgtacagtaccaatagtaactccagctacaggacatgtgcacttacatacccaaacacaaaaacacaattaaaaataaaagacatcttgaaaaaaaaagaaaaatgtatatttttaaattctgtgttcaacaaacctttattgtgctctgtatcatcaggccacggaagtagctaagacacagtccctttaagaagattggcatcttcctttggaagaaacagatcaaccaataacttatataaaaatgcccctttgctactttgatgtcattttacttgtgttagagggagaaagcaaagagggctttttgtctgcaagagttgttgagatgctaatctctgtaggtagggctcagcagatgggaaaactgcctctttcttttcaaggccaacctgcccctgctgcagcgagaactgctgcattgtgcccgggctgccaagcagaccccatcccagtacttggctcagcacgagcaccttctgctcaataccagtatcgcatctcctgctgactcttctgaactgcttatggaggttcatggaaatggaaagaggcccagtcctgaaaggtgagcagagaagagatctgttctattttcccggagctactctttgctttaaaagaaaggaggtttggttggtggtttgtaggcagatacatgtcttagactttccaagattagcttccctttgtcccagtgactgttcaggtaactaactgcacattcctgttgagaagttctgccctggagtttagacatgaagactcagctcctgtgattgtccagtcccttcagccaatgacaagtcttaggttatgattgtgaagaagcaatattatgaacaatagaaagattactacagttgaagctgagtgactaaaacccctaccaagtcatagaggctgttttcttcccagtagctgacctctataatgacagatttgaccttcagcattcctaaaccttgtcaaaccttgtcccattcagtttctcctgtcctgtgtcatgattagatggttctgctttctggacctctcttcttcacactggaataaacaaacatttacatattgtttctggcccctgaagacagttcggttcatgcctcttgttaagccattcctgagctgggtacgggaacacacaccagaagtcacagctattgcagaggcactgaagtcagatctctgaagtttggctgacgaccagcctgagtatcatactgacttaagggctgatggtctaccagtatgaagcatgtgtgtagcatgtgggctgcagcaccaaaaatcaataaccattctttgaagacttcctgctttgtaaagtacatagtatgtgaaggttgggtttcctatgaggtgagttgctgggaagaagctgctgtcctgagacttggtcgggatgtgacatgagcacttcttgataggcacctataagcacttctgattcttctgcaggagggaagagaatagttttgaaagagatacaattgcttctgaaccacctgccaagagagtgtgtactatcagccctgctccccggcacagtcctgccctcactgtgcccctcatgaatcctgggggccagttccatcccactccaccacctcttcagcactatactttagaagacattgcaacttctcacctgtatcgggaacccaacaagatgctagaacaccgagaagttcgtgagaggcaccacaatctcagtaagtggtcgcagcagcatgacaatgctttaatctggagggaatcatgggttgcttcctattcagtgaaaagcccagtaatatcatgattgcctttttctgttaagatgatgttgtgcagctggacgtagttccacatgcctgtaattccaacattatagaggctggagtttgatgatcagctcagggtcaccctcatcctcataaggagtttgaggctagcctgtgctatagacccccccaaaaaagaggactgggcatggtggcatacatattagcagtcaggaaaatagcgtggtttacacgagtctcaggccagtaagagttgctttgactctatgtgtgtaatctgatggaaattgcttagcctcttgagcctgagagtgataactttttttttttttttttttgccatttttctttattgagctatacatttctcccactccccttcactcctcccctctccccttccattcttctcccaatactcaggagatcttgtctatttccccttcctaggtggatccatgtatctctcttagggtcctctatgttttctggggttgtggcctgtaggttggttgtcttttgctctatgtctaatatccacttatgagtgagtacatattatatttgtctttctgggtctgggttacctcacttaggatggctccttctagttcagtccatttgcctgcagatttcaagatgtcatttttttttttttttttttttttttttttcccactgagtagtctccattgtgtaaatgtaccacattttccttatccattctttggttgatgagtactaggttgattccaggttctggctattatgagtaatgtgctgtgaacatagttgagcaaatgtccttgtaatgtgagtttgcatcctttgggtatatgctcaaaagtggtattgctgggtcttgaggtaggttgattcccagttttctgagaaactaatatactgatttccaaagtgactgtacaagtttgcactcccaccagcagtagaggagagttcccctttctccacattctccagcttaagcagtcatcagagtctttaatcttggccattctgacaggtgtaagatggtatctcagagttgttttgattcgcatttccctgatgactaaggatgttgagcatttcctaagtgtctttcccccatttgagattcctctgttgagagagttctctttttagattatttggtctttggatgtctagtttcttgagttctttgtatattttgaagatcagccctctgtcagatatgggttggtaaagctcttttcccattctgtaggcaactggtttgttttgttgactgtgtcccttgctttattggagcttctcagtttcaggaggttccatttatttattgttgctctcagtgtctatgcagctggtattatatttaggaagtagtctcctgtgccaatgtactcaaggcttcttcccactttctcttctatgatgtttgatgtggttggttttatgttgaggtctttgatcattttggacttgagttttgtgcatggcgatagatagggatctatttgcattcttcttcatgtcaacatccagttatgccagcaccatctgttgaagatgctttcttttttccattttataatttttgctttgtcaaaaataaggtgttcataaatgtgtggatatcaaggtcttcgatttgattccattggtccacctatctgttttttatgccaataccaatctgttttcattattgtagctctctatatagtagagtttgaaatcaggtatggtgctgcctacagaattcctttattgtacataattgctctggctatcttgctttttttttttttttttttcctgtatgaagttgagtattgtcctttcaaggtctgtgaaaaattgtgctgggattttgatgggtattgcattgaatctataaattgcttttggtgagattgccatttttaccttgttaatcctgcctatccaagaacatgggagatctttccatgttgtgatgtcttcttcaatttctttcttcaaagacttaaagttcttgtcatacagttcttgaaagtaataacttctgaaatgaatgaagatagtattaccatctctgcttttttgttaggtttgaaatgcctgaagcataggcctgtgtaactattaaatttaagaataaacactcccattttaaaaacccacagtcctaatttgagatcagtttttgaaaagagctttttgtcacattctcttttgtaaatgaatctttagagtttaactcctcagtatcaatcaggcagggaaataaacaaagaaacaaataaatgaaggctgccgtcttgatgggtttctgttgcattccatttgttaggggtacctggtagaaaacacattaactttttcccatttggacctaagctgactagcattttcccaaggcaaaaacctcaccagggcctcatgttttatgcaattcttactgaatggtaaaggccatgagagcattgtctccatacatttactgagtctcagctaccacaaattatttgatttagtctttccagaaggtctggacagtcattaatttcttcatacagaaaggatcaaagcaactgtggccagtgtcacataactaatgagtggccttgacaagattcagttcctaagctgcctgatgttgaggttggctacattggcaacatgtggtgatacataccattcttagtgtccttccatactgtctcatgccttttgtttagcttgggggtcatcaagatggctcagtgaaaaaaagtcacttgccatgtaagcctgggtcttgagtttgatgcctgaagagaattcactccataaagttgttctctgacctccatgtgtcatcatagtcaacatcatcatacacatacagacacagacaataataacattaaattcgttttcagaactagtcttgctattgatttttttcctcttcatacacagtttctgtccatttgagaaagaagaatggtgaaagctaggtgtggggtttgaaagaaaatggcccccaaagggagtggtactgttaggaatgtggccttgttggagaaagtatgtcactgtgtgggcaggcattgaggtctcttttgttcaaagattccctcagtgtgactgtcagttgacttctgtggcctgtatatcaagatgcagtcagcatgcagtctgcctgcatgcagtcttgctccccactatgatgataacggactgaacttttgaaactgtgagtgatccacccaattaaatattttctttataagaattgacgtggtcatgtcaattgctctgcacagcaataaaaaccctaaggcagtaggtataaatgtattttgttaaattttacttgtatctctaatagttttaggaaaactatgtatctacatctggaattgtactttgagattgttggtcacctaccatgtttaattcaccaggttcatcaaagattcctttgttttccttagacctattaggaaatgtctgccctattatactggtccatattcaccaatctatcacatgcccctccccctaatcgaatcagtaataagtccactcccctttactcgcctgaaatgaaatctgtgggcacaatctatagcctaccttatatctctaaatttaggatctatagtctatccaaaatataaaaaagtatttacaataaaatgtagtagtgcttagacattagaagatagcaatgaaagatagtgtttagggtgtagctcagtggtaaagcaaacttgcatgtgatagagttaaaggtgtgcgctacaacacttcttagtcagggttcccttgctgtgaagagacactggccacagcagctcttataaaagaaagtctttaattggggcttgcttgcagttttagctgtttggttccattatcagcacagcaaaaagcatggcagcatgcaggctaacatggtgctgagaggcctatatctggatctgaaggcagcaggaagggagagagagccactgggcctgactttgctgtttgaaacctcaaagtccattccccagtgacacaccctctaatcctttgaagtagtaccactcactctctggtgactaaacattcaaatacgtgagcttgttgggccccttcttattcaagccaccaacagagtacttctgatattttattttccaggatgttggatatgaaaggcttatgtgaacaaaggaaaagggcatagcccctaataacttagaagatttgctatccttagaaggtgtttatgctctgtctgtacttccttttctgatatgacctgttgtgtttgtttttcttttgggatttgtctttacaactgaattgataagagtttgggagttgtgccccaaaagtgctgggaatggaacccaggtcctagtgcatgctaggtaaacattctgtcactgagctgtacttctagtccctggagttatttgatctgaatactaactctttattggttaacattaatggttgtgtcatttttgtgggtctcacaccaggtatggtaacttactcccttggtagtgtgctctaagttgacataactgtgttgtgtacacttgatagaattcagttgctctgcattctttaaatataatttcttgtttctaatagatctgaatggaggctatcaagatgagttggtagaccaccgtctgacagaaagggaatgggctgatgaatggaaacatcttgaccatgtaagaatctcagcatgtttaatttccctaagtccttattacttttaaatctttatagtttgttttgctttttgtttgtttgggtttgtcgtgtatctgtgtgcacatgaacatttgcatgcatgcacatttgtggacatgccatgacttgaatgtggagattcagaagaaactatttggtcttgttccttagcagaaaggtccctttacattcttaaccatgttgcctgcccacttttgtttttactttcctattcaggcatgcaccactgcatccagctcttttaattcttattgctaccagtagttcatgtgtgcttgaagtgaacatgacttttgaacagaagttgatttgttcaccacttctcaggtgaagagctgcacagtcactcccagatcttggtggtagactggtccctccagttcctaaaacaggtagtcgtggaatagatggttaaagcaaagattccagttttgccacttgttgcctttgtgagctcaataaattactctacctcttttagccttgattttttttcctttaaaaataaggttcagtgatatggctctgtgggcaaaggcactttgcctaagtttgattcccaggactcacatggtgggtgggggagaaccaactcttcacaagttgtcctctgactttgctcatgggccttggaatgtgcacatgaagacacataaacacaccactaaaattaagtaatctttctcctctttcaaaaaaaaaaaaaaaaaaaaagctgggcgttgggggcgcatgcctttaatcccagcactcgggaggcagaggcaggcggatctctgtgagttcgaggccagcctggtctccagagcgagtgccaggataggctccaaagctacacagagaaaccctgtctcaaaaaaaaaaaaaaaagaagaagaagaagaagggctgataaggtggcttagtggttaagagcactggctgctcttccagaggtcctgaattcaattctcagcaaccacatggtggctcacaaccatctgtaatgagatctggtgccctcttctggcctgcaggaatacatgaagacaaaacactgtatgcataataaataaatctttgaaaggaaggaaggaaggaaggaaggaaggaaggaaggaaggaaggcactgccattatttgtaataacacataaagtgtttattatggagtgtggcacacatggaaagttaaacaaatccaagttagaattagtatgctgttctctttcccatcagagaagagcatctcttctccctgaaaataggcagtgcctacttgaaaattgcatattgtggtttacttcagatattattactgttactatcatcatttgaccctggtccttacctagggggtaatgtattcatgtgtgtgtgtgtgtgtgcatgcatttgtctgtcacagagacagccccagattgtattattatagaaacatctagctttatctaatgataccaggtattcaagcctggtgaaaaattctaactcactgagctgttagcttacagaccagcagtttttctcatatatatatatataaaataaacgattattttgtgtatgtagttgtggtggtggtatgttgtgccacaatgagtattcaggattcagttctctccttctaccttgtaatttccagagggtagcaagtattccttacctcttgagccatgctggcctgtataaagacttttttaaagtcacataagtatgtgggtagatgtgcacaggatatatgtaaatgccacaccttttatataagggaattggagcacttgtgacttctagtgttcctggaaggttctagaaccaatacctctgtagttgtcccaacccttgggacagcagtctagggcaagatatccagtgggggaatggtgacaagagatgcaagagaatgaccacaagacaggattttgatcaagtggcaacttttattttttccaggctagcttatatagtcagtagtatagggtaaaggggagggggagaagaggcctagagtcaggtgttagttcaagcaggatgttagaaaattatagaaggaggatattggcagggtaataagttcatgggtggtggggagagggaggtttacttaggtcagtggttgggacttgggagggttgcttaggtaagtgggcctgtggttagaacaaagggtttgacgtctggatcatgttgttccttctgggtgctcatgcttctagaagccatttataatcaaaagatagttctataaccgtgtggcgtgccaagtttggcctaaaggtttatgccaagctgtatggctcccaacatacctccatggataggaaaagatagctgtatatataaaataaaaagatataaaagggactcagtggttaggagcacttgctgttcttgcagaagatccaggtctgcttctcagcatccacatggcagctcacaaccatcagtaactctagttccaggggatcctgttccctcttctcatctctgtgggcaacacataggcacatgcatttgtgcagaccaaatactagcatgcataaaataaattaattttaaaaagcaaggaataagaatgactttcaaatgtaacctttattcctaaggttataaaatctgtgagtctccccctcccgcctcccagtggtttgtccatccttgatcttcactgtgccttgtttaagtgtctcatctctgcctcactttctctctggctcaggccctgaattgcattatggaaatggtagagaaaacgaggcggtccatggcagttctgaggcgctgtcaggaatctgatcgtgaagaactcaactattggaaaaggcgatttaatgaaaacacagagatgaggaaatctgggactgagctagtctccagacagcacagccctgggagtacagattctctcagcaacggtaaggatagaaagaggtaccctagaaggaacagcaactttcattccacttaaacatcagatagatctaagttcattgttattctgaagcgcttgtttggtttgttttttgagaatcttactatgtagcttagactagccccatcctcttgcctcagtttctcaagtgctgggattaaaggtgtgcaccaccatgcctaactacatctatttagttgtgtatgtgtatttgtgtgccatgtttatggagggtgttggttatttcatcccaccatattggttctagggattaaacttctttttttttttttttttttttaaactggtatgtgtgttgggggatgtcagaggacaacttacaatattcaatattctttatacaccatgtggtttccagggattgaactctggtccttatcctctactacaaaggccgttacctattgagcctgacttctccctgccacattacatgcaagtttgcaagcctcaggttcttctattcatgttctgatctgctgaatatcaaccatgcttcccataattccctctttaggtttgattgatttgctcaagctgctcacaggctcagggaaccaagcttatctgtttacaaatgacacacatgaagagatacaaagcacaaggtctaggggaaggaacacagggcttctctggacctgccacactcagaaattgcacatttcagctaaccagctttctgaatcctgtgccttgtggactcattgcagttgaattacagtagactggatggggaagtcaaggaaggcttgtgtgcatcagtgctgttctgcagcactccttgtctaggtgatgggggagacccaccagtatagtatagtatcagacaagggtacattcaaacagttttgttactttagggtttagttttattgtgtgttttctgagatgcgttctcactctgtaatctaggctgacctcagacttgcatcagccctgccttaggtgagattacagcatgaacaatcagcaaatcctatggttttgttatggccagtcccaatgtagaaagctttggttgggggaggggggtgaaggcaagagtaagaggaggagaaattcaggcttgtatggcctccagtggaggaattgttagccagaaacaatgatgacatctaaactttggtgactggggtgttgcttaatgatgagtatttgcctgtcttgacctgagttcagcatagcaatagcagagatcagcaagggagaaagaaaagagtaccagttatgtatatcacatcttaactagatactttgatggctgcactcaccatattccttcttgatggtattcaccccactttgctttctttcctcaattactctccacttcctggtagcttccttcaaaagattagcttaggcaaaactgggttgcacatcttgatgcagcagagatgagcttatatccaggaagctagagttatcccccagaatgttccatcacttttacccagaagctgaaaaggtgccctatccaaaggcacagctgaatgacaggccatctgtgatcacactctctccacccacccacttaaagttcccaaatgttcatcaaagagaatgaatttcttcttatgacagtgctagcgtttttcatagaagacagctgttagtctcaaaaggactggaagagaattttgaggaaatgccagcattaataatgtgtgtcctatcctaaatagctaagggctaccactttctcctttaattgacaggcgtggctcttgagccagtcatcaattggcaccattttatataggatatctagtatatcaagaaacaatttacaatcgagcacacacgtttgatttaaaacgtcaaaaaacaaatgaggctaattctcgggtcactctaacaaatctgaaccttaacaaatattccctaaagcaacttagagatccttgactaaagatcaacatccacagtcatacattccttccatgagtatgcatgtgtgccgctggggtggcagagtgcaggccagcagcactcagtaaaactctgctgtgctctgtacaaaccactctaacttgagggtctagcagggacgacccatattgtctggtgtgtctaggacggtttttattatttttatggtccatcaaagtcattacaagcacctctctttcaagatgaagacaatttgatgaattctagtcactctagatttagtgtttcacggactcctattaagagtctgagaacattgccagcctgtctgatttcagttgtatcatttgtctgggatacagtttagttgacatagtgtttacttaacaggcactaagccctgggcttagtccctagcaccacaaaaactgggtgtggtcttagggcacactgtgcttacaacaagagtttcaaaagttaattgctagtctgaacttcatgaaaccctgtctgaaaggaaggagaggaagagaagagaaaatggcagggtaagggctagaggaatggctcagcagttaaaaatactaaatacttttccagggggcaggactttaggtggctcacaaccatttttttttttttttttttttttttttgagacagggtttctctgtgtaggtttggagcctatcctggctcgctctgtagaccaggctggtttggaactcacagagatccgcctgcctctgcctcccgagtgatgggattaaaggcgtgcgccaccaacgcccagctttcaccacttttaacttcagcttcaggaaatctgacctacctaagcagggcactcatgcagactcaaattcatacacatgtagtcagactttttgtcgggaccattggctccccaataatgatacacagacttatgaattataaaagcttggcctatagcttaggtttgtcccactagctcttataacttaaattaatccatttctattcatctacatgttgccacatgactcgtggcttttacctgtcctgcatgttttgctccctctccgtctgaatggcaactccacctttcttcttcccagcactcaatctgttcagaagtccctgctatacctcctgcctagctattgactgtaccagtcagatagacgcatcttcacatggtgtaaaggaatattccacaatacaacacacacttaatgaaaatcaattataaatcttttgtttgttttggtttttgtagatggagtttctctgtgtagccttggatgctctggaacttgctctgtagaccaggctggcctcaaactcacagagatttgcctgcctctgtctgttgagcactaggattaaaggtgtacatcaccacttccaggctaaatataaatcaagaaaaagaaaaatacaggattggttatgagtggcaatgcctctcctaaatgaaggaatggggtatttatatcatacagtatttaaacatactaaataatgtgtttctagataaatagggtttatttctctttcagtgtgtgtcagttttagaaggaaagcagaattcacagggtggactaaactgttgcactggagtgtattgagtgtattgtttgctttaagaaagtctttggctggcatggtatatgacttttaatcccagcactctggaggcagcagaggacagcctagtctacatagagagttctaggacattcaggattacatagaccttgtctcaaaaaaaactttttaaattttttgtttttttaaaaaaacgtgtgtgattgcttttatgcctgccgggtatatgtaggggggggaggggtacatgtgctataattacctgtggaggtcaaagaacaatttctgagagttgattctcctttatttgggctccattgatctaacttggtttatcaagcttgcatggcaggcagttacctattgagccatctctctatcaccttttttgtgtatgtgacagggcctcttgctgtgtaaaccagttgatttttttaagtgctacttttgtttgttttgattttgagagaggtctctctgtgtagctctagctagtctagaacttgttatgtagcccaggctggcttcaaactcaaattgatctgcctgcctctccctccttcatgctggaatttacaagtgtacactaccatgcccaattaaatgctattttacaagtaattgcactatgaaaggtcatatgcaacagcactctgaaagctgaggcaggaggattttaaatttgaggccctcctgagttgtgacatactaaaactttatcccctactccaaaaaagcccagatcatataatgcaaaaagataaaattgtagaaatactttctcctccttatttttcttatagattttcttatagggtcacttactaacaaattaatgttgtcttacaattttttctatgttcatatttaacagagttcccccagttttttattttgacattttcagtctaaatttgttagcaaggcctataatcccagttactagagaggcaaaagcaagaagatgagtccaaagcttgcctgagctacagttcaagggcagcctgagtaacatgggaacacttttttctaaaagtaacaaaagtgagcctgggacttgatctctagtcaagttacactgaattcatgtatataatgtcccaagttttatatggcccactggtagacccacccatttatcatgaacaagggcctaggtttgatccccagcaccacaaaaaatttatgcttacctacttaaatataaagttgagtatactgtttcataatctgaagctagctcttattctgaatatgttttgcattaaataagcatacaggtttagatctaggtggtaaatgagaagtctgataagaaattttgtgtcagggttagagattattcttagagcatttgcctagcttctataagaacttgggttttaagtactgggtaaagaaagcttctgaccccttgctctttatctcttatgtagattctcaacgggaattcaccagtagaccaggaacaggatatgtgcctgtggagttttggaagaaaacaggtgtgtatctgtctgttggtaagcagtctgttcttactagtttatgcaagttgggaacccatatactagggaaaggttcataaccagcttttaagttgtctacaatgtcctcctcatggaattgttgtcttctattctccctctggctcgtctgcacgtctcctggactgaattgcctgcctgatccttggcaggtcaggagtttcgaatgggtccctctgggccttttaacgcccttctacaggcttccattgaaacatgaagtacctagctcttctttcattttgacaaaagttgaatttatttctgcttggtctctttgctgatatcatactgtgtctacattgtcacaacatttgctgaattttgatttttttttttttaagttttcttgtttgggaagcagaaatagaagacttgccaaaagtttgaggctagcctaggttatatagtgagaacttactaaccctgcctccttgaaccctactaccctccaatgttgtgggttgggagggaaaagatttctctgccagttgattttactgttgctttcttccagaagaagctgtgaataaggtgaaaattcaggccatgtcagaggtacaaaaggctgtagctgaggcagagcaaaaagcctttgaagtgattgcaaccgagagagctcgaatggagcaaaccatagcggatgtcaaaaggcaggctgcagaagatgctttcctggtcatcaatgagcaagaagagtccacagaggtcagagctatgctgggctctgggctgggctgggctgggtggctgaaggggagcaagcccattgcttgctgctgaggtgctgggtccaaagagtccactagatgatgggagttttagctaataccagacgacttttttcttgattgaagatacaccaaaataataaatcatttttttggaatcattatagtctatcacatactcacaatatattgcttcagcttccatgaaggcagaggtttgtcccagctgtagttgtagtgggctcattgtgtgcagacagatacctagctatgtatgtatacttccttttaatcctcacagtaatctcattatgtagatgttgattctcagtttatagaagtgacagatagatagactgcccaatgccctatccagggcccaaaattgggtgatgcttcaatacaatgaaaaatccaagtggacacaatgtttacacacctgtaatcctagcatttaggaggctgaggcccgagaatttagagttcaagatgagcctgatacacataggggaagatgggtcacaaagacaaaaaataaaaataaaaaattctccaacccaccacccatctctcagtactgggcattaaatttatggccttgggtatatttggcatcccaatcttttcttgttttattttaagacatggtctcactgagttgataaactcagcctctagaggagatgggactgtagatacatgtgttcagccctagcactagaatatttgaattcagtgaattttgttttatttttttgcatataggatctctctgtgtagccctgactattctgaaacttgctatgcagattaggctggcctcaaactcagagagatctgcctgctcccaagtgttaggatcaaagatgtacgccaccactcactcccagcctgtaactttcatttagtcttgtcctttttgttgttgttttttgttttttgggttttttttttttgtttttgtttagttttttggtttttttgaaggatggtagatttttgagacaggatctttttatagcccagtctggcctggtactatgcaatcctagttgttattgggagatcagtccttttgcctcagtctcctcagtgcagagatttatagatgtgcgccatcatgccaaccttctcatgttagtcattctttaggtttaaaatataattttaagcagcaaactaaaagtagtctgcaggtgagatgaatgccagcatggatcctggcaaatttgcacttcaaaaggaagaacagacatcttaagcttttggtgagtttgcagtggaccagaaacgctgattctcgtgcatttcaagaaatactgctaggtaaatagcagtttctccatctcgtgagaagctgtgtggcacaggagaagcatgctactcctaccttctcttcacactgacttatcattaaggatcagttttctctacagagggtacaactgctctgtccttttggcctgataaattttaggaagataaactgagtttacatatgatactattcagtggtgtgtaaactacagcagctcttactcttggctgcatagccctaggcctgggttgcttttctacctgggaaggtttttttgtttgattttcttgagatagggtttcttttttagcttggctgtcctggaacttgctctctagaccaggcttgccttgaactcgcagggatgcacctgcctctgtctcctgagtgctgggatcaaaggcatgtaccatcaccatctagcactctgcctggaatggagggggggggagtgtcatctctctaacgaggcatgttctggccacagctccaatttttctggcaaatacaataaattagcaattgatcatgaagtggagagtcctttctcctgtgggccagggctgccaaaagttttgaattgagatccaaggcttttgacaagccccaggtaattctgatagaggttacctgagatgctgacataacagtggcctctccttaacaaaggagatcctagaatcataatcctgacttctctaactagtgactcaggaggtttatgaccttcccacaataactatagaagagccaagtctgtggctcagattttaaggaatgctgatctgaaggttgactaaacagtaaacattttggttttatttggggccaaggtttgttcctgagatagggtctcacagtctaggctggtcttgaattcactatattgccaaggcttaccttaagctcctgacttacctgcttctgcctcccaaatgcagggattaccctttgtttcaagaagttgtcttacttaccatattgcccaggctggtctcaaattaaatcttagcctcccaggtagctagaactacaggccagtgccattccttcacccatgtccttccacactaaccgtactatacctgcatactaggagcctatctctgtaggctacttactttgttctactatatttcacatagcatgaagatattgttgaatagtggcagtcaagatggaaatgttggtggcttggtgttctgaccaggttcttagatgttcttggagacatctggagtgagaggcagcctgtagtagcaacctgcataggcagctcctggcttgttcctcacaagtgctatcaacttgttgaagtattgatccttggcagcctatcagactctcagtgttgcctgaagatgtgtaaatgtaacataatgattatgtctgttctctaattctgtcctatgatgctggtagtcatggcaaggttttactgcccctatagtacacttcccaagaagcctgagttaagagggatctgtagtcttttctgatgtgctttgaagtaagtctgtgtatggagtatctgggcttcaggaaacccaggttctctaggctttgatgacattctagccttaccacatctgggcctcagttttcccatattacaatgctgggaaggagccagtaggcctgtttatattctggtcaagcgtcctggttttaggaagaaggctgtctttcttccctagctagtactgtagtcaggcttttgagatggaatccgccattctggtgtccttgtaggcaagaaggctagttgctctgtccttgatagtttcccaaaactagaacctttcaaacaagcaaacaaacaaaaaacctttctttgaccagtaggtcctgagagttttcgggtgtagaatattcacatgtcactagtgtattcctcccagaggtagcaaaggacttaggagtcagtggtggggctccacagcggtagtgttttttgattgttttgtttttaatgctgtctttgctcccagtcacctagagatgttagtaagttgtgtgtttagtgacttggtgactgtcctgatgctttcctggctgctccttgagctcttatgttatatgatagaattactgttcttagctggtactttctgctgagcctcaggattatttgccccactctgaataaatgtaacaagcagtaagaaaactccctgagctccacttcaggtacccccacagttcagtgaccttgaccacagactacagcttcccctcagcccatctggaatgtgacatgacagtgaaggaaataggcacagggacaaaggaagcagtagcaaagccacctccctcttcatccatcctgattccctggcaggttacttggggggaaaagaaatctgttttcctatatgcctttaaaaatatttgttaagagatcaaatcctagccagatggttgtagcacacacctttaatctcagcatttgaaggcagaggcaggcagatctctgtgagtttaaggacaggttggtctacagagtgagttccagaacagccagggctacatagagaaaccctgtcggggccaaaggtggggtggggaggatcgaatattgtcagtaaaagacggtgaagatggttcctccattggttgctatagaaaatgtttggtcaagcctcatgtgtggatgtgtggtcttcagaagatagttgtgagacccgggccaggtgacatgtggccatgatcctggcatttgggagggagaagcaggaggatcaggaattaaaggtcatcctcagaggactcacccacaggtgtgtagctccacgacccttgttctaccatgcagataacaagtgacagtggcaagcctgcccctcaagatatcagcagccactaactgatgcctgtgtcttgcagaactgctggaactgtggccgaaaagccagcgagacgtgcagtggctgcaatattgctcgctactgtggttccttctgccagcacaaggactgggaacggcaccaccgcctctgtggccagagtctgcatggccacagtccccacagccagagccggccactgctccctggagggcggggctcagccaggtctgctgactgcagtgtgcccagcccagccctggacaagacctcagccaccacctcacgttcctcaacacctgcctctgtgacagccatcgatgccaatggactctgagccacagactccaccagccctgatgaccactccacatggcagaatgcttgcaccagggagctggcaattgaaacaagtagctgttgagtcatcagcaagaaatgaattggcaggaagcatccaagaagcattccacagcttctctaggatttgccacatgtccttgggagaactggtgtgtcattctctgcacacggaaagtagcttgagcctcctccatgatgttcctgatgtttctcttccagctaaaactggcataacctgcctcttctcagcgtagaccaccaggctccctccaactccttgcatcagcagattgtcagtagtgtccaccaggcacctgtgccccataccatccatagtagaggcatgaaggctggaagcaggctaagggagacctttcctccctctgcctccaaacagtttcttgagctgcatcttcaccctcagatggcactgatcagtttaacagactctagtagccaaaaagcagtactcaggactccttcctgagccactcaaacatgccagaaagaagccaccacttcagtaaagtctctagtaatggtaaaaattaaagcagtctttcccaagcatcatagatcattttggacaagattttccaacctggccagctccattagcttggaacccacctcccagctccagtgtttcacttgattttgcttgtgcaaaaataatctccatcgcatggattggtctgagagaggatgaaaccattgtgttagtcttttctctgagcatgctggccaaactgaaatattgagtgcatcacctcttggaaatgcaaaaccctttgctgttgcttgactgtttaaacagtcgtcttgttctttgtgtccttctgtctctcactgtgcatgtctggatcactgggggtgtctctggcccataggttctgtttggcacctgtcaagctacagtttgaacagtgctcctgatgctggtagattattcatacctggttttatggcattacaccacttcatgggttttatcaggtgaacattctcagcctcctttttctatgttatgtgtttaatagcatccctcacagctcagaaaggatttgtgaagtgtgggaaccgttttgaaaagcctgaccagtttttcttcccatcttcaggggtttttccaattacctgattctccaaatagagtatcatctgtacctatttaacaggctaagtactgcctctgacaccttttctactgctgtttgaggtttgttaggagtcccaggacctttcccctcccactcagtatcctcctgccctgagcagtcaattagaatgagtcatcaactttgatctgttggcttttggaaactgtggtcaccttctgtacaatgaccacatctgaatattattagcccttgccccataaaagcatggatgtcattgtccttgcatatagttacagctgattttaagatttttgaaaccctacttttttgaacaagaattttcagcttcagaaacttagacttttaaaataatttttcagcatacaatacccaagacctactagttgtcagacaatctggtacagcctggcatccctggccacatccccttcagcctgctgttgagtatcctagccactagggacaactttgctttactaggtagagtcagtaccagacacaaggctgtgtcatgagaagatcacaggcttctgggaatctgagaatgtctcccggtgtaacctgggttcgttatttcattagtaaattggatgaacatctgagtgttaaaatcttggagccacaggactactccaggtggttagaatatagagctagaactagaacactacttcttaccaggttggagatcagttcctacagcaaaggtttgggttaagggcctggcctacttttgtgggctacatggttgccctgacagattctgagtttctgtttttgtttgttttttgttttctgagacagggtttctctgtgtggctttggagcctatcctggcacttgctctatagaccagtctggcctcaaactcacagagatcctcctgcctctgcctctcaagtgctgggattaaaggcgtgtgtcaccaacgcccggcctagattctgagtttctatagtcctgtttgggaactgtttggcttctgtcccttcacagatttgtctatagacctggacagggctgcagactagagagttcagttttcagactgtcactgtcttgacgctggtcagcatcgctcttaagtggcatctgctgaggactgacttttcacactccgggagctcccttccgcacttctccaacctccccccagtcaggagaagcagcagcatctagggtagcagctggagtgagtcccggcttcccacttgatttctagtctgccaatacatacgatccaatacttgactggaagtgaacataaagcttccactcatccactctaagaaaagaagaaacagctgagtcaggctgctcagaggtctggactcccagcagtaactatttggggaacaaaaagatgagggctttatcatcccctaccaggtgaaagataaaattgcagaagccagacaacaccaaaagtagtgcaactggagttatgcaaccatccctcactccagcaaacggtgaagacttggtaggtaggacgctgtggaagttaaaggagatgtggcttatttggtagtgtggctagcatgcagaagccctggattggattcccagtatgacataaaccagcttatctatcatctcagcacttgggagatggaaagcaggaggacgagaagtttaaggtcatccttaaatacatagcaattctgaggccaacctgagttacataaaacctatctcaacaaaaagaatcacattgaagaagggtcccttgtagctccatcagattggctcatgccagcaggtggcggtgagggcataaactgagtggctttttcctgagtcactaaatcacgtgtggaaacatctgcctgcccgctcaggtctgctcagggcattggcagttaccttcagcagtgtggattcttttacccatttggtccccaggaggtgcttcacttcttgatgtcaactctagcatctttagcttccagaggggatatctacattttagtttgtatagccctgtcccaaaagatggaagtgacccatacctgcttatagagggtgaagacatttttctgagtggctctggaagctatctcagcaagtatgtgaggactcaacagaactgcaagtgtgtattagtggagcataaggaatgagcagatggccatcgtcctggaaactgcagacgggattgtgggttgaaaaaaccattacaaataggacacatcttggaggctttcttcagaactggactagaaccaaggtttccaggctcctggctcagaagaccaagccagcgtgctttgatgaatgttagctgtttgcagagaactgggtggtggcatgtttgaaccaaatgtgagaaaagccagaagaaactgagctggctagtgtgggccaggtggccagctgtggaagatccttgacctggcagctgcttagcagagcctgcccactcaagtatattccttgtaaagccaaaatgctgaactacctgcttctgcctcatgtgttgacacccctttccaaagatgatggagtaagtgtgagccaggaagaagttgagatggtgggcaatgatttgaccctcaatctctccttccacagcccaagaggtaggtggtgcttcccactcagaccccatcttgtcaggcctccagctgcccagtgtacactgtcaatgcttataccaaatagggcatgtgcagctggtgtctgtcagggacagcccagtccctgccttgtagttgccagggagaagctgcaacaattgttccagtgaatggttgaaagggctgtttgatacaaggccttcattccactcctgtggctttccaagttcctgatgaggctgcaaaggctccatccctacagaaaaccaataatgtaaatagaaagccaagcttccaagcatggtttgcagaggttggtgatgaatgtgaagccacccacaggatacatttgaatctggtttttctgtgctttgtcatttgactcaataggaacttttgttacttaactctgtgcataacttatttaatgtactgtataaatgaaccaaaactgttaaatacgtatttagtttgttctacttaaagtagttaataaagatgatatattccttttctgactcaagctggactaggtctgggcaagatagtatagtggtggcaatgtgtgtgccaggtggcctgtggcgggctttagtgtcatcgtgcaccacacatggtgcatcctcctccatccccaggactttggtgaaggggcagcggagctgtggccaaaagagcatgagattggccaaatcaggaaggaggtgggctgctgaggagaaagattctagcacagaagtctctaagagcttgcaattagacccttccatgaagccagttgcagccatcttctctatcccaggaaggtctaagtgaccatgctggttgcagtagattgccaccaatagtgtacagacatccttggttcttctccattgagtaattttactaagaacattcagccacggaatgtccttaggctaatcttttcctagcaacatttgttattttcttacaaagtttcaacattaacatactagagtgtgtgaaaattttgtcttttctgtgctagcattaattcttaatttcactgatgctgtcatttgaggctgtactttacctcaaagtctcattcagcttcactgtttggtgtctggtgccctctggaggacaaaatggtgcctgctacttctgcttccatctgagctaattcctacctagggtgctcctctgactgcttttgtctttttctggtctttggccttttctgagtctgtctctctttccccccccccccccaccccatcttccaagatagggtctctctgtaacagccccagctctcatggaaattgctttgcagaccaggctagcctcgaaactcagagatataactggcatttctgagactctctctatcctatgagttcagatgatgatgttttgggtacatcagaagtttcaggagaattcaggattcagcatttttcttgtgctagactctaccttgctttgacatcccttagacctcaaggcttagtaggccttggcacactgtggaactgagtaaaacctgtcatcactgtccctgcttcttagctaggatactgctgtcaagggatgcccattttcagtgcttcccacacttgacagcaagtagcagttggtaccagggcaaagcatgcaactgcctgtgtgtctctcctgtaacttggggtgctagcattgcctactcactgggttgtgagggtgaaatgtgatcgcaagagagccaagaagagcatgtggatattgtttcttaaatcaatgataagcaagctgcaattcatagagccacggcagttaggtttacagcaagggatgggatggggggcagatagatcttattgggaaagggaggttagaatagttatggatggattggtggggggtgtggaacagaaggatcaaggggagaaggatgagggagggaatactaggagagaggcagctaaaattaagagccatttgaggggtagtatgaacctaaatatagtaggagcttccaagtacatatatgaaagtgatctaaatgaaatatcactaaataatggagacagaacctgaactggctatctcatcaccaaatgaaacttatggtactggaattgagttgcatctaattgagctgttggccaaaggagtcccatgggaatccccaaacaactcaggctgttgcggagactacagcacctatgccaatcattggacagggagaagttgagctgatggctacgtaagagccttcacccctactggcagtgctagcatctttggtacaggaaccttcctgtactcggcatgctaacaaacgaaacaaacaactcagctaacaaccctttgatctacagtggtgtgttaaggaaccacctaatacctgacttgacttaaggtccactccacaagatgaaacccatacccagcactgcttgggtgaccaagaatctgagattagctaacacagggacctggggtaaaaccaaataaagtcacaacaaaatgattcctaatgaccctctctacctcagacactttgtaacactcagccctaaacaggatgtgtcccctcagggctcagggaatcccatgaagaggaggccaaaagagtgcaaaggccagagaggatggaggacaccaagaaatcaaggctttctatgtcaacatgatcaaagctcatatgaactcagagattgaagcagtatgcacgggtctgcaccaggtcctctgcggatctattgcagcttccagtttagagtttttgtgattcctgagtatgtgaatgagcaggtctcttgattttcttgggctctttttcttatgtttgttttgtccaactcaaatgtattagttttgttttaccttattatcccttagaaccttgaacccttgtttgtttgtttggtttttgagacagggtttctctgtgtaacagtcctgactgtcctggaactcactctgtagaccaggttgacctctgcctctgtctttcaagtgttgggattaaagacatgtgccaccactccctggctccctttttgttttcttacaagaagcagaaagggagtggatcaggtgggagggaggtgggcaggaactgggaggagcagaggaggggaaacggtatgttaggggggtctactttcaataaagtggggggcacaggggttggaagggagccaaacagttatggtggcacatggctggaatcccagcacttagaaatgaccacaggaaaattgaaagttcgagtttatagtgagtttgaagccaacctgagctacatgagatcctgcctcaaaccagggactggagagatgctcttccaaaggacctgggttcaattccacagctcacaactgtctttaactacagtcctagggatccagtgccctcttctgaactctacagacaccaggcatgtggtgcacagacatacatccagaccaaaaaaaaaacaaaaaaaaaaaacaaagaacttctaacattttttaaggggtggagatggctcattggttgagagtactactcttgcaagggacccaagttcagttcccagcactcaactcacaacaaactccctgagaaccgaagattctgacttccaagggcacctacacacacacacacacacacacacacacacacacacacacacacacacacacacacacaatttttttgttgttgttgttttgtgtttttaatctttggggctagagagctggttaagagcacttactgtaccagaggacctgagtggagttccctgcacccaggtcaggaggctcaaaatctttatgggcttttaagccggccatggtggttatgaggcagaggcaggattgccacaagtttgagttcagtgtgctctacatagtagatcccaggtcagtccatctccatagtgagagtccatctctacccctgtcactaccaagaaaagtgtaatggcggtgttcaccctagctttggccagacagctcctgttagcatggctgtcacactttctcccagccagtctgatccctcggtggctcacctatccttgtcctctacatggaagctgtaggatttattcaagtaatatctacttcaagaatgactttcctggttcctgggaagcaaaagcaagtggatttctgtgagtttctggctagccagggctacccctgctaagaatgacttcttgacaaccctactttacagtcccctcattatatcttctcaaaggctgcatcaacaggagctaaggtgctgtgagcaatgggcactgtccggattgctgcatctggcctgatcctaagccaagccccagtcacagatgtaggcagttgaggatggtggagttgctcctaggtaaggagccagaacactggcttcaggattcactcagcccaccacggcctggttgctaacatttcattatccctagtgcctatcacagagtatgtctccagtaacagttgggaggtgatgctgagtccgtggctttggcttgctgctgaaaggctgaggcagtgtttgtctagagtaggcatcagtgcgaggccagggaggggtgactaaggcaagggatggcccctcagcctgcatgtgatttagggaaaggggagtgcatgaattgggagtgggaaagatctcaaatgtcagaaaagaaatgtcatcaacagcgaagaaaataggagccattgaagggtcttggctaaaagggatgcggtgaccataagaatgagcattttgagggccccattccagtacagagtgcagcctgatgaagctgctgtgtcactgtctgagctgtgtgttgtgaagatacaagacagagaagaggtgggctgtgggagtacacatcattaaaggcctcactaccccagcctcagattcctattgctaagactccagattcatagcgacaccttttggaccttgttactccaagacagcagtgcagctgcctgggtcctggcctcctccagtactctctgttcactctctcccttttgcggcttttctgccccaccacttccccatccactaagatcccctgcttatacttgaaagactcaaaccaagtccctgtctcctagaggactcccagcaggatagatactccctccacctgcagtgtcctctctagcagttctgagccttcagcaagggagcaaggatactctaaaatagagttagttgcacctggtagcaaaggcctctaataccagcatctcaggaggttgaggcaggggaatcaaaagttcaaggcctgcattgaaaacttactgagatcctgtcacctaactgaaagttaaaaccgaagtcggacatggcagtgcacagtgaggcagaaggatcacccaagtgtcacactgtctgcagactaaggtaaaacatgaagaggctgaggctgtagctctgtagaacagcgcttgtgtaacatgtgaggtcctggattcaatcaccagtgcttctgaagaatacaaataatgaccccaacacttgaaaggcagaggcaggcagatctcttgagttcaagctacatagtgaagaccctttctaaaaacaaaagcctcaaggccaggtctaagtgtaggcctatgtcccagcacttaggaagctgaggcaggaagagcttagcaaattcaaggcttatctgaagaccttgtgtctctcagaagtgaactcagagtgtgaatagtcagattctgaatgttccccttctgaggagactgccctggaactcgctctgtagaccagactggcctcgaactcagagatccacctgcctctgcctcctgagtgttggtattaaagatgtgtgccaccactgcctggcggtttgaagcatcttaagataatggggccaggtgtggtggcaagaaaagcacaacttccaagctagcctgggctacttacaaagtaaaatcttgtctcaaaaacaaagcaaggggctggtgagatagctgtcagtaaagtttttaagaagacctgaggtcagtccccagactcttatttttaaaaagccaggtgaggttgagccctcattactggggaagtagagacagatggatccctggggcttattggccaaccagcaaaacctcagcatgatttggttcattgagacattgtctttaaaaaaaaaaaaaagtaccaccacctgaggaaccacacgtgaggttgtcctctggccagtatacatacatactacacagatacacagacagtgatgtgttttttttccatttgttcttctgtggagcccaaggcttgtccactacaagaatgtctactgcaactcatgcctgtagttttgagagcctgttattactgttggtggggatgctgccacacaggactgaccgcagggatcattcctcccagactggttccttctctaaggagacactgaaaccacagtgtgggcaacaaacttctccaaggagccccagggcccatagggaacagatactggcagcacattctggagcctgctgggttcagatgctggccccaaagcattcaggcctcttggttgaggccccaaaggagaaccacagaaaagaccctgcctgcaggccatctctgtactcctgccagcagagatgtttttctggctataccccagcacccagcaaggatctggcagtcaggcacacggggacatgaatgaagcagctctcagaccctggccaccagccttggcttcagatctactgcagcctccagaatgaagctcttttaagggccctgcctccccagctgcaccctctgccttcttccttccccctggtctcagtatccctcttgtttggcttcccttggttgactggagttgggtatccctgccgctcagagcttgggatccccacatgtgagacaggtgacatccattccatgctcatgtgataccatatgcctcctgtagagcatcacttgaggagtccacattagttacttctcagtcttgttctgtaggagtcctccgccctgcaatggctgctaggaaggactcctgggtatgctatttggagacagtgatgaggacaggcttgcttggcaggtcctggcatgagataggtccactcaggaatccagccaagcaggctgtttggaacacctggaaggctctgtagggtgaagctgagcttggaccatatcctttctcctttcccttccatgcagggctctggaagcaagatctggggtatagccttgagctgagaatgatgatgaagctccctcattctgtgaggcagcttcagcgagggaccaactgcaacttccttccctgagtttcgcatcaatgtggccaggaaagcctggccttgccaagagagagaagagagacagacagacagacagacagacagatagacagaggcaacaccacagatgaccaccaactttattgcctctgcccaaattattgctactctgcaaggtcttcttacgactctcatagtgccctgagatgccgatgggtggggtgaggtcatgcaaatgatatgcaggtaacatgcaaaccaacccaggatcccccagagggctctggcacagccactgatgctagaaattctagggctgacccagaagggtgatagacacccaggtttctactctacaccacagactatgagttggcctagcctcaggggtcaaggttccagggtttgagaggggtccctgagcatcagccctggttctgccactggttgaggaagaacagaaacctaaccccagaacagcaaggaaaagcaggacacccctaggcagccagagagggaggggatctgcctgggacacagagcaaggcagagaataaagggaccagaatctggacttcctgagtcagtcagaagcccaggtgcttggaagctacaaacattaaaataaacaagcaagcagccccgtccctgatccctgtgctgacaccctctaccagctgaccaggctaaggcctgggaacaggcaggttccttggtcttagtgtagagttggccaatgcaggaggctctagaatgataggcggggctggagagtcaccagcttaagcagacccgactcagttattattcacaatccaccaggaggctgtgggtgagagattggggggtcaggagctggggggggctgcccctcatgggccccagggctgtttggagcacagggatacagcgcacctgggaagaacacagtggtgagggtgtccgggacctgcaggtgatcaatgagggtacgctggaaggccttgctgcagggcgactgctggtgcctgagagagccacagaatagacagaggctgcagccatctgctctaagatcagtgctctgggttacccaagattagtcctgctgcctggactcaggcaccaatccttcctctactacttttagcctcagtcttcctcctcaataaaatgggaacaaggcacctacatcactagactgctgcaaggagtaaatgaaggcacctagcacagggtcatccacttgacgatagtatatattcattgagtgcctcctgtgcacctggcattgtattgagttttttgagtttgtgttagacagggccttgctatatagtccacactggccttaaatcattgatcctcctgcctctgccttacaacttctggggttttaggtttgtgccaccatggccaacttgtgttattctatatgtctgtttgtctgtttgtttgtttgtttttgagacagggctgtgctgaatttgctgtgtagcccaatctggccttgaacttttgagctctcttgcctctacctttcagtgttgatataacaggcatgcactggatacctaatttgcattcattctttacaaatcatctcatctgggacccagatatgttaggtcagttatctgaagtcacacagccagtggacaggagagtaggacttgaacctggtccagacacttccagaacccatactcagtgtcagacattaaaccaccactcaccttctccaggaggcttcatcctgccaaaactcatagagggtgaaggtagcatggtctagcatcttctcagcagacacactgaagagccaaagaggtagccaggttgtgaccaccactgcctacctgccagtggtcttgtgggagctctgcccggagtacccagcccaccatccctccctgctcacccctccccacctcagccatctcactagctagccagggactcactgcagacaatggctctgggcccctgtcaagttcatgtagcagcacagggcacggtgaaaatccggcagggcgtcctttgccacctgtacttgcctttgtgccacaaggatgtgctggcaagagagcagctcgtcactggggtaggctaggcccagagtataacttcacccttcctaatatggttcagatcgccccctgtggggggaggtccccacagcccacaaggcctcccagcatctctgactccatcctccaagccattgaccatttaccctctctgcttaccacctcccactctgccctctagcttccatccctacttcagacctgactgtcagagagacagatcggagaacagaaaacccaagagggtcacagagcaagaagcagaacccagcacctgcctaccaggtctgagtagacagccattacccttcttcgtgagtactccgtcccgagctcaccgagtcaggacccttggcacagtcctcttcatgcaggggttccagccggggtgcctgcaagggacaagaatataggccgagcctctaacatgtattggtttgagcaagtgccacagaaatcccctctcaggggcactggccgcccagctgcttaccttgcattcaagctggtctatgagctcctggaggcggttgacctgcagccgccactgcagctcagcctctgaattccaccctgacaggggaccaggaggacatcagccaggggcccctgaacctgggagtcctctcagggtaaactgggaacagtggcagagcaaagccttgagagaataggagattcaacgtgttccccggaccctatgcagcctgctacaagcacacctgtatcgaaggatccaggagagcaggttggtgaccagcttatgctcctcagggctctgcgtcctgcccgcctgctgccacggaacctcctctgcacctccatattttcttcatccaacctagaaagtagaagttcataggctcaaggactaggattccagcacaagaccaagcttaggtggggcaagacaggtttcctgggtctctgaagcccagccctcaaaccacccatcccttctcaacagctcacggcctccctgtccaagaatgtagcctccagaaggctgagtggatcgtgacactgaggagtttggaatgcaagaataaaaggcactcagaccccggaccaaaggtcaacatcgctcacgtaccgctgaccacgggcctgggcctccagggtgtctgatgccccctccaaggagctctgcagggcttgtagctgattcacagtctctcgaagcaggaaccgtgtgacaaactggtccaccttggaggcctgttcatactcctgtgggcagggcagagaggtgtggctgaaggaggagcttaccttgctgtctgcctgtgccttgcttgagagagcaacagggaatgtgaaaggtgtagagcatgcaggccctgcacaggctggtcactcacactctagttttgttttgagacagagtgttaccttgtattcaggctggccttgaattcatgatcctcctgcctatgcttccccagtgcctgccttccgagggcccccttcctggtccaggctgggtgtttttgttttgttttgtttttccccatcctagcagatttgaagctgagttataagggtcacaacccactggtacactggttttcctgggtctcaatttctcttctttgttaaggctcatcctcatctttgccacagccagtgaggctcctgggcacagccaggcagggtaaaggtgcggaactgtatggccaattttacacttggtgcaaaatgatgtgtggtatggcctcttaccgacctgttggacccaaacttaaatctacatatgcatttgtttgttctttcattattccattcaccaatctgtgtaaccaacatttactgcatggactttgtgagacattacatatacaagacatccaggttactaaagaggcacaaacatactccagcctacactaccagcctccccttgattcctttaaggtaagcagggacagggagaattttgtttcatctgtggggggatgcatttttattttttgagacagggtttctctgtagtttagagcttgtctgtagaccagactgacctcgaactcacagagactcacctgcctctgcctcctgagtactgggattaaaggcgtgtgccaccaccacccagagcagagacaggttgactgactaagcttcaggccctgtgctgacatcttgggatactctcactcctccagctgcttttgccttgtgcctccgttttcccaccgtaccgagttgaggttcccctcggttacttgctacatagggctaagcctagtgcctgcagtcagagttctcagtctagaaatgcaaccactgttgtggaacataccattagtaatctgcccagctacacacctggacagtcaggatgcccttagaagcccgcacccccaccacacacccagacctaagatgctggaagtcctggggagccatgaagaccaggctccacagcaacttctatcataggctcttgtctgtcacctgccttggctcaaccaagatggtaccttctgaaccaggcttgtaacaaatgggacagaatagtgcctgattcctgtcgtgaagtttgtgggttctgtttccatgacatctcttcagttacttccctttggaggtataaggtaactgatcagttttctgctgtttgcaagcaaaaaccctggttggcagaaccacccaccccgtaccagcctcatcccaagaatttcatttaaccattataatttgtaagaactatagttgattccacttcatatctggggccgagagcttaaccaaggttaagcacctaatcggtggcagggcaggattcaaattaaagccacagaaattcccctctacttacctttaagcaccttataggtgctttgttaaagcactagccctgtttcacagttgggaattagagaccagaagaggtcatagacggtgaatagaggccagattctcaggggaggagcacagctttggtgtggtgaggtcacttgtgagctcacaatgcagttcacttagtggggcggggccaaacggcacccctgggtagagggcagggccgaggcagcatgggcagtggcctctagtgaccagtcctaccatgggaaacagcagttcccacaagagaatcaaagcacccagtcaggccagcaaggacgggccgcctgacatggacaaggcccgtcacaagcagttcttcagccacctcaagcggaagaagccaagtgtgagtatggggatgcccgggggaggctggatgctggggtctccacctttagagccagaggcatgagaggggttagagaatctctttagaggaggagggtccctgaagcccacacaggtggtataagggacccagaagcaagggctctttttaaccagggggcaggctgggggccacagacatggaatatcctttaccccctctctccagcccacagcctcacaacacatcactttccccttctttcaatggcgagaggcccctgattccgcccgggtgggtgagaatccccgcatcaaggctgggaaagtacgcagtggatcggcctagggtggacgatgggttcctgtgaggaggcagggtcccgcccggggtgtgggttgagcggccctgatggcaccgtggggtttgggaggttgggtcctccagatgcgcgggagtggcttcatgccctgctcgggcgcgttctttccctcacaacgcgcccacccccagaccaagatcgtactgcttttcccgctggacaagcggcagcagctggccgaggcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgctgtatgcgcatctgctgacccatcgtgaggcctgcggtgaaagcgacccccgcgaggagcagccacgcaagcggcgccgctgccctcgtccgcggccctgagtgcctggtgcggtccccagcgctagggctctgctcaataaagagcacatagcaacctggtcgtctgccacctttgtcccggccatcggatccaggttcaaagctgaggcccccgggtgagtaggaatgaagggtactccacaacctggagctagggctgcttttatcttatctttgtggcacaaaggccagctcatgccagaaccacagatttaaggtggtgggcttgagcaatctatacttggcttgaggtctccagagtcctcaacgttcaaaaatccctcttaggcggagggagggtcccaggctgctaacagataccataccaggaagaagagtcagccatggtggtgcggaacctaagattctgcctgtggtaacacactcaagaagaggggcttgagcctctggtctctaactcgtgcccggcagtgctcagtaactcccaaatattcaactccccaaatgttaaggtcccttagtcaaagcactttcctcctgaggtacctacccagttccatcctctaccccacatgtagccagaagcttcttccaaaaccctaatctgtctagagcagttcattccccctgatcatagcccccactgcttctccactaccccccaagcccaaggctaaaattgggatgtgcagtcccagctccccagcctgtcttccctcagtacctctcagtgcttgctccctgctcttccacactgacatggcaccagtggccttcaatgtcagtcttactccttgcatcactcctgagagaagcaacatgctctgggcagaagcccactgctggctttcttggatcccacacacggcttccagacctaaagctaccgtctccagttgtagccggctgagataataccaccactcaaaaggatggggtaggaggatcttgagttcagtgcaacagattgcttcagaaaacaaaatattctgcctttcctactgcacactgatgaccaactcaaaatgcttcccctggggccagtggtagcaggatgaaggtctcagctcactagagccataagccatggacttaaggatacattttgtcactgtccacaggcttgaatcatgctggaaaatgtgtgacccatgcacagcataggtatttacttgagagctaattgctgtcacgtggttctctcagtaagtgcacacttggcctacactggctctatcatccccttccccgggaccataattgggaactttaagagaccttcccagttaaccacagccctgtggtcgaattctgttcctaagtcctatttcgtccttgtgatccagaaaatatccagtatccgtgtaatccttattttagtctaaatgcatctgagtcttctatttgcaaccaatgtggtcctaaagagaatagtctgtccgggaggtgaggctcattgctatcttttggaggaagaaacaccagaaagatagatttggacttgcttaggttgatacctaagcttcagaactgcaggggtcaggccagaccccctgtgtggctgtcggctaagcacaagaagtcctcattgtagctgtagatgtgtggttgaaacgtctatctttagaactgatttagaagggatagcgcatatgtctggagtacacagatactccaagaatttgggagaaagaattagctggctgtgctggtctaccaggcctctattatgggctcccaaatggctgtcatcagcctggtgcgggaggaggggggtggagcactgcaagactgaggtcataatgagcccaatctaagttcctttcttttcgaaccatttcttccacctccacagccaggtaactctctagccaagctaggtgacgtgccaagagacttcctaggagtcccggactctggaaccctaaggaggaattaagtactgactaacagggccacatcccctctttggggtggagccacaaaaaagaaccgctccccctaataggcggggcctcgtagtcagaggcggggctgagaactgagagctggttatctgcccagaaggcccacagggcttcggggcacactgagcccagaaggtggcgtcggtgcacaggacccggcatgtccgcaggctgccgtcattggaccacgttgcggtggtggtagaccaaggctccggcttcaccaaggctggcttcgctggggagatccagccgcgcattatgctgaagagctcgagtctgatgccaagttgggaccggcctgtgctgcccgaagcaccaggttgcgagctggcgggcggcgtggcgcgtgcgcaccccatcaagcatggtgtggtggtggactgggacgcaatggaaggactgtgggaacgcctaatggtgggaggcctgcaggtccacccagagcagtggcctgtgctagtgagcgactcaccatcagcaccaccggagggccgagagaaggcggccgagctgctgttcgaggccctgacagtgcccgcgtgccacatggccagcacggctctgctggcactctgctccactggagcattcagtgggctggctgtggaggccggcgcgggcgtgtgccacgccacacccatctacgcaggtcactcgtggcagaaggccaccttccgtctgaacgtggcaggcagcagtctgtcgcgctactttcgagacctactgatggcaacaagccctgatcttcagccgcaggctctgccccgcaagaccgttacacatctcaagaagcgctgctgctatgtgtccctagatttccagggcgatatctgtaaccctgcccgccaccggagggcctgtttttgcctgagcaatggctgctgcgtgcaccttggcagcgagcgctttcgctgccctgaacctctcttccagccaagtctcctagaccatcctgagccaggactgcccacattggccttccaggcactgcagaagatacccataaagctgcgggcacggctggccaatacggtggtgctggctggtggttccacccttttccccggctttgtggagcgcatgaacctggagctagaggcactgtgccagaggcttgggcacccggccctaaagctctgcctggtggctcaacctgggcggggcacagctgtgtggactggaggttccatgatggcctccttgcagtcctttcagtgccgctggatgactcgggccatgtacgaggagtatggtccttttctggtgcgaaaagtgttcgattgagttttatattgaagtagaatgggtgccaccaggggtactgcaggaacagaggctgcaactctgccctagcaccgagaaccagataaacagattgaagtgtttggagctggcagggttatatgtggatgggctgccctttttcctttctgggctaaccctgaccctcattttgctttcatttgaatacccaaaccaccaccagttcagagaatgtcagtccagcagggccaggctcaaagaacaacacttgaaaaaataactcttacacgagcgaactagaagccccggacgcctaggctgtgtgctcaggtgatccttgacgttctcaattttccctttcgtgtagaaagtgagatcaaagggcagtgactagctgtgcagtgcaaggccttggggcctatcaagtaccaaaatgtatgatcaggtaaagcctcagacctgctcaccccacccccagaagatccatggacatggggagagggaccttttccctctatttttggagacgggatctcaactatatgcccaggctggcttctgtctcaagctgtcctgactcttccaaatgctggggttaaaagtgtgaactacctctgggcagtgtggtggtacatgcttttaatcccagcactcgggaagcggaggcaggcggatctctgtgagttcaagaccagcctggtctacagagtgagttccaggacggccagggctacacaaagaaactgtctccaaaaagaaaaacatgtaagctaccacatagtcttggcagatggttcttaatacataaagggagggtattttgttttgttgtgttttgttttggtcactaagggtctggagctctgactgtcaacccttgtctatacatgttgtaatataggccaacagacatgcaggcagacacacacacacacacacacacacacacacacacacacacacacctgccttatcacgtgtcctgaggtcaggctctgcctcataggctccatgcacctgtggacatgcatgacctcatctcctatgtcctagcccatgcctgctaggtcctggcttgacaaccctcagcaattacatcaggccaacaaaaacctactatgttgcctgaattgttttgggtactgggaatatagcaaagaacaaaacactagatctctgcctctcctctctcagcagggtctcactctagccaggctagcctgaaactggcagcgaatcttcctgcctctatctcctgagtattgaagattacagtgtgagccaccataacccacttcattgttcattgtcacctctggcttatagatgaggaaaccggaccagggagtaaagggcagtcattaagtgggaatatccgaatctgaacccaagttccatttcaacagccagagccatagtaggcaagagtgccacagcaccaagccatcttttcaggttccctataagcccttccctgcacttaccagctttgtagtgtccatggcggtgagcaccgcacggttcagtgactccagtgcagccagcacaggccgatagacacccaggtgtttggagaaatagtctgtgggcagaacaggtgctcaggggctccagcccacaccgtctctccagcctggaattcgccagctgccccagccttcctaccccgtaagactagcccataaagcaccccttaccacacccacctgcccaggggctgggacacaagggccagcacaggcctactcaccacacagtttctctgtttctaaattgctgtgagggaaagagaaaacatccttcagactcttagaacctgggcctgaagaactgaacatagaagccggtggccccatccttttattcagcctgacatggttatctatttggtggaggaaggggcataggcacttcaaagggtcagcccaagcctttgaagccttgaatgctgacaaagtctcagctgtatactaagggggagggggaggagaggggaagggcagctgtgcatgttcctggcgtgtgtccccaagcagagaagcagggaaggagtatccacttgaatcagatgtgtatatgtgggcacgtgggaagatgtgtattcctgcacctacatccacaggcggaggcagcagagcccagctgtcctcagacatcctctgcatgggaatggaagggttgagcacgggtggtgactcaagcctggttattctggggtcccagctggaagcagtgtagcaacaaggctggagctgaagaaggtgtaggtgggtggataaagttggcattgggccctggcgtcttttcccccaaccttcctggcctccagaaagagccatgacagcaggggacacagtgggttggaacaatctagccaggcactgccacagcaagtcactgcttctattgtactcactcggtgagatgtccatcgatgttgctgaacagttcccgcagctccgctgagctgagaaccccatcagcaaagtaattctggaattcttcaaatgagagcttaccatcatctggggagagacagggcgtggagttggtatccttgagtcctggctgcgtcctgcccccagatctaggctccccaaaggcctgatagcattctcaatcactcagtgagatagcctagggttctgactttagtggtggccctgactattttggacaaaagtccccaaaagtgtatgctgaaggaaacagggcccaccttgtacaagaaatacaagcgaccagccttggacacaccagagcatggcttgggacttagaagcacagtccctggccacataaaatagcctttcctcggggtcacagaagcaggtgaagccttctaacagtttgactctaccatgcagcagactggggacatgtcaaaagaggcagagaacagaggtgcaggatggttaaagatgatgggattcagtctgggtgatgagcaaaggtggggagagcctgagcctctgccacaggatgtcttaaatcaatggtccccaccagtctgaagaggcccacaaaaggacaagtacttggggacacaaggaggctgaaacacacgaatccgcaggcccagggagaatagaagtggaggttgaatgggtgcctcaccacctagtccagggtctgcatcccagacacactaattaaaggcttagacaactggtgtacttccctgagcctctattccttgtccatgaaatgcaatgaggaattcccacctagaaagctgttgtaaggacatcacaaggtcttgtacaagcacccatcactgagctacgtgccacttaacacaagcccccacccccaggctcgggtcaaccccatttacctgcacaccatctgttctctaggcagtatcccttgcttgacctctcaaagacatcactctaggctgtacctcgaagtccctagttctcttaccctgcctcatccccccccccaatacacacactgtgggaccaaggggaagaagccacactcaccgttcttgtctgctcttcggaaaacctaagggacaaagggaaatgagtgggtgctgtgagtggagcctgagaggtagaagtccccctcccaagccagtgaggccccagctggccagccaggtcctctgcattgacttcctcctgctcagggcagtcctgcaggagtctccagcaaggaagtacaggaagatttcacagcaagtcctaacgctgactctctcctgctgcagggtggcttcacagtgggtaggtgctcctggccagctctctgtaccttcacctcccccagcctgagttcactctgctgtaacagcctttggcatggtcccagcttgaggaagcttggacagatgggccaagatccatcctgaggagctgtggaaacctcatcagaccggaacccctactcctctgtgtgttgtcctatagtgcaccccgttttccatccaccctcactgaacaggagcttcccttgtgcctgttgaagactggcaggcagtggctagccctctgtgggtgctttggttttcccagtagtagtgagggagtagcctgagtttaaccctctcagggctggggaagaggccatctcattgtaaagactggtcatctgtgcatacacgtttgtgtgaggggcaaggaggatggcaagggtcagcagattttatttgtagaggcagggatgaagcagacacagcagcttccttaagtgctgccctcctaggaactagtcttccaaagcagctgaacaaagagcatcaggttcaaggtctggacagaacccccataggccagggtcctgaatgctaaactcttccacccaagtccctcagggtcactggtctaaacaactaaagtaaccctaacccataggctgactcagagaaggcctgctactagactgggatcacgcagcagctcagtgtggcctggctggggtaatggggagggcgggtgagacagaagagctaagcttggaatgaaggcactttcatccacatcgttgtgtgcccctgattccgtctgtgacctggaacatgtctcctctgacctgaaggaccatggtcaagatgctgagtcactaggacattgaggaaggggcatgacagcctcccccactggcaagtcccgctggagtatgggcaggagagtgccaggaccagctgggcacattattgaaaggtttaaaaaaagggaggggcggggggctcagggcagtggctgaggcaggtcaggatgctctatagccacacaagggggcttcaatgccacctgctgctaatgagaggcgtcctttaccaactgtagaactctgccacccttggatcaggcctgaggcttctggggcaggacagagctccttctaggtccaagctcccatgtcccatcagcccagcaggggctgcaatggagcaagcaggtcggtgatggctgctgtgactgagtgttgacagcccctaagccccactggccaaatttggggtggaggacggtaacactattattgcagagacaaggagacacggagcggcacaacggcacagacagtataaggaacacaaaggcagggggatgagaacagcagggtcacggataatccgggagagggactgaagcagaaccaacaaatgaggagggagagatggagacacagaggaccgagacctggggagccctgcgcccacccaccggtgccctactcacatcctggaaaagcgcgtgtcccgcagcaggcgtggggtgtcgcggaggctgaggcgcgggtggcccaagcaagcacacagcgagcaacccagcgcacgccatggctcagaagaagctcgtaaggctgcgggttgcagttcccaggccgcctatgctggctgggggcggggcgcgtgcccattggtccaagcgtggccccgcccccatctggcctcggtttccctgcctggaagaggcttccaaaaggggtgggataaggaaccatcccaggggccactggcaatgacagcctgccagttctacaggaccaggtgctccacagtctggtgtggacaaagctttagatgcagaagccattaactggtcaaactcacaagctcttcacctctggtcatctgtggaggataatgggtgccccccccccagattgtcaaagggattgcagatgttcagctcaaaggactcccattgagggtttgttaacgcatgtcatgactttccagtcataacccccttctcccagatctcagcccacctctttcaggaaccttgttttctcacttgcaaggcagggttaaagggaggaacacatgctgcaagtacaggacacatacaaacacacacaaaagcatcggacacaaacacagttgactgtgtgttgcatctttactaatgctcagaaatgtccggaaggtgcacagcaagccaactctaacactcccttttctgcacttaggtaatatgcatgacttcctaccagtcactgggtcattttcttcctctcaaatggttacatcatagaaaggaaattaaatcagataggaaaagggaatgaatattccctctgaccctagcctcacattggcatagagtcccaaacccagccctaacaccatcaaaatatttattaaaaccaaagcaggagggaacagaactgttaagaaacaaagtgcaggctggagggtggagaagacaatggaggagcactccaactacaggagggacccacccctcctccttgtccaccctgtcagtgaaggtcctcactcacttctcccatctcaaatccacctgggtgcagctagggtgctggcacaaccttctacaaggggaccatttctccaacccatccgtggctgtcagtctgtttcccacctcccactttcccaataaataaactgcaggggcctcagctcctttggggttggaaaaaaaaaaaaaaaaacaaaacagctaggggaccctgcccttgctcagagtataggaagttggggtattagcccaatctcactccaacccttagcttattccccaggctggccagaggcctcgataaataaataaacgctccattaaagcttcgatcgggaaacctttaagcagtgctattgctgccctgcaaatgcagccagccaagctaccccacctggccaggctgacacacaggattctgggagcaggcagccaccctgggcctcacaaggcctctgcagcaaggacaccaaaagtgcagttagagccccacccccaccccaatgcgcacacatgaattcatgcacacatgtggacacagcaggatgtgtctgcagcacacatacagatgtgttcaccttcattccccggtacacaacacacacacacacacacacacacacacacacacacacacacacagaatacatcccaactacacagtgcgcagtatggggtgcacatttgcgcatgcgcgcgcacacacacacagaccccacacaaaatccttccccttttgctctgctcaatctggcagcagccaaaccccagacccagaagccactgcacagagaagagagtataagtcgtgcttttccaatgaggcaggaaggatggcccagggcaggaggctccaaagctgcagacagggtgggcatctccagacaccctggctccctagacttctgtcagaaatccagaggggtcaggtccccaaagtcacagtcaaagagatctctgatgccttcaccctcctcaaggccaaagtggtagtcaagggcctcttggggcggggaaaggctgatgaactccccagggaggagccccgagaagtcttctcgaacatgctccaggagtgagtcggcagccaccagcggtgacagatggtcttcttccatgggggccctcaggtggcccatccgtgacaatactggttctggggaaagcatgcattacaggttagagaaggcccagcaggaatggggctgccatgactgcctgccccaataagcaaacaaaacctacccctacctaccttgctccaggcctagcagggactggctgggatccaaggttggggatgtggagggaggtggtggtggaggccctgcagtgccagggtcagtggtcctgtcttccccagaggatgtctcctgggatggggtcctcccagggctgatcccccctgcactctcctcaggacacaggaaaacatcgatggggccttgtttgctcttaagagagatctgaaatgtctgggtggaggcatcaggcagggtaaacttaggcccaggtgaccatcagcccagcccaccctgtcttggtcaggcctggggtctcgagtctcacctccgcagagtccacagcttgtagttgggtctcaggaggggccttgatcactatgaccatctgttctgcagggtccgctatgctacgaaggtcctggcaggtcacataggccagggttgggggagtcaaggaccatttgacctttgaggagcccctgactcagcccacataacaggacccacacctacctagtcactcctgtttttactccttcatcccaaggcctggcacaaagtcagtactcagagtctcattcccaagcttcaactgccacatctgtacagtgggctatctacctatccaattccaaactaatggctacctgtaaataactccacataaaatgctcaacagatctccaggctgggagatggaaattacttttgacaattttactcttaatggtattcactaaaaagacatattctaatgaagtttcttttaactttcaagctacaatcaggcactaaatcaatgactaaggaaaggtttgtcatcactggtaatagcttttctcttggatgacagggtcacactgtgtagtccagtggcctgtgattatttgtatttagacagcctcactacatagtcttgattggccctgattatgtggcagtgtctgcctcatacctggtcctgggatttcaagcacacaccaccttactgggcttttcttctttgttttattgagagagggtctcattgagtatccttggctagtctggaaatatgtagacacggttggcctgagttcagagatcttcttgcctctgcctcccaagtgctgggattttgaaggctgtacacacaccaagccgggactttagtgcgtgtaagtattttccttgacatgtattctgcatgagtgttttcctgacatgtatgtgcatctcgtttgtacctgttaccttcagaggtcagaagagggcatcagatgcattaggactagacttacagagagctgtgagccaccaccatatggatgcaaggaattgaacttgggttctctgcaagagcaacaagtgctcttaactgctgagccaactctccagtcctaggcttcttttaaaatttactaaaacttaatacttactttgtgtgtctttgtgtacatgcatatacatgccacaggggtgtgtgcacacacacacacatgcaggtcagagaacaactaggagtcagttacccccttccaccagggactcaaacttagatggctaagattggccaaaagcacctttactcatcaagccattgggttggcactttttctcttctttttttttttttttttttttttttttttacaagaggggtttttttgtgtagccctggctgtcctggaacttgctctgtagaacaggctgtcctggaactcacagagatcctcctgcctctgcctcccgagtgctggggttaaaggtgtgtgccacatcacccagttgttttctttttttaatatgtacaattttggaaatggtattactattctcttttatagatgaaacttaggcccataaaagccaagtaacttatcgaggcagtggtggcacacatctttaatcccagcacttggaagacagaggcaggaggatctctgtgagttccaggccagcctggtctacagagtaagttccaagacagccaggactattccacagaggaactgtcttgaaaatcaaacaacaaacaaaagccaagtaacttgttcagtgtcctgtggtgagtaagtgcagagccaggccttgcttccaaagccagaatctttcagaatccagagccctagataagctctatagtctcagtgtggtaccaccatgttccctggccaattcaaggatatcgctggctgtctgagtcctcagaaagcagctgcagctgtgtggtacagatgtgcatcaggcggtccaggtgctgctcgctctcctgcagttgctgtaggtcccgggtcaagccttcaagccgcttactgatccccaccatggtgcggctgcctctgtgggaagccatgaagagttagcagtcctcagaccctccatccatcagccatggcactcaaggcagtgcaccattgttctgtgagcaagctctttcccctctctggctctgctccccagctaggctccaagttagactgacatggacttatgcctggtctgtcaacaaacacctacatgtccccaggtaaggaaacaataacacacactgccatacaatgtcaccaagacacaccgacaagtgaagagaacgtaatacggaatgaagaatggtctatcaaaaaccaagaaggcagatgtgccagagagggcagcaggatgcctggggagaggggggtacaagagagaaatcctaacaaaactaaaacatctgtaaggccaacctcagtgatgacagcacaaagctggaatggtgtttacacagtggtccaaaaatgggcaacactgggagagggaacaggaaaccttcagcaggcgtgtttatgtgtttattggatgggacaccttgtacagctatagggagctggatctgtaagatctgtatatccctccctttctaccaccccagggaagacacctctcctcagaggcaggaagccactgcaggcctggtctggctaccaccagcctacctgactggtcagtacttacaaccactggatatgattcttggacttcttggcaatgagctggatgccctcaaggacattggtgatgtcatagatgcgccgtttctgcactttgagcacctcagccgcccagttcaggtcaacaaccccatcagctgagcggctcagcagctccaagaagcgtttggtggtcagatttaacgatgtctcatatcgtgacttctcccctggagatttcacacctggggggcaggggttaggctaggcagggctcctcaaacactcagcctgcccccaacaggcctgtctccctagcagtgtagagtgtcaggatgaagtgggatgcagagggctccttccccttagtcaggccaagcagaaaggccctgtgactgctgtctgccaaccaaagcattcctctgtggctggggaactccctacctccaaggcccaaggaagtcatgtcagccagccattccagctgcctgctggggccccagagtttacaagcatgcccacccccaaatctgggcctgagatgctagagtcatcaagcacctttgcctgggtggcggcctctgccccggaacggcccactgctcccagccagatactgatggtcagtttccagatccagcctccgtttcacctgtaacagaaacacaggaagatgcccagtaaccaggagtgagaccacctcagtcatctattaggatgcctagggatacaagcagagacagatcctaagggacacagcattaggttatcctaccacacataccattcaagtgcaagactgagttcaagttttaggtccaacaggtggttttttttgttgttttttaaatacatcaccaaagaacaaatcatggcagtaatgctagagattaaaatgagggttttgtgcatactaacacacaatctacgtttagtctcctcagttcctacagcccagcttgtcctcaaacatactatgtagccagtgatgaccttgaactccttttctccctgcctctacctcccaaatactgggcttacaggcacatgccaccaggacttgttacttctagtacttctttcaaagataagcgctaacttccttccccttactagccagaagtgatggtgtccctctgagactggtcacagaggccctggagcttctcctatgaggaagcaaggagcgggagaagagctgctgcaccattctctcatgtggtcctaaagagaagccctgctggcaaagagctgagaactccaggtgaggaggaacaacacaagcttagaagcaaatccatccagcagccttagtcctgccttctgattacaactagacagttttctgtctgcaacagggtcccatcccaggcaaaagctccagctgactctccctcaagtcctggcccacagagactacataataagccaccaaggaagggtctaggtcccttgggcaagcaagtcatttctctagtttttaactcatttacccatctataaccatggtagcagctggtgcctttcgtctggcaacacaatggctccactttgcagattaaagcaacccacattcaagatcacagtcaggaagtggcagagacacagttcctacccaggtctgtgtagaatgagcaaaagcggctaattcccatgccctctagcttaggctagacatgcagagatggaaaggaccctgaaatcccacggatagtcaagacaccctaacgggaccagacttgctgtcctctcaccagccacaggcctttctcaactaaacccgctttcaacctggcccaccacctgtcacattcatttgccaagaattctacccacagctattatcaccctcccactggacagtccagctgtccctacactggtctccctccacatctctgccttagtaaagccttccaacagcattcctcatgtgaactgctgagacggacttctcccgacccctgcctctaaggctcagcctatgcccctctcctccagcaggacccttagcaatcacttagagagatgctacccttctctctgtattgactcagacccagccttctcctacatccattacaaacagctgcagaggtgtcagtcagtcttccccgcctacccctccacaccagcaacagtgtcactggatccagtgaatctctacctaagtgtcagtcaacatgtgttgactctactccacatcctcatgctgccacggacttctggaagcttgaggaagaggatcacatgtgggcagacatcgtctatgctgtctatgcagaacagggtagtaactgcttctcatacatttcctcaccaaattcttgcctgatagcagagcctatggtggtctccaccttgggacggatctgtagcgagggagaaatccaacatatgtaccccaatgggctgaaagggccctacccagagtaacacccctacgtacaaactagcagggagtgccttttccctagtactctggcccttgttgaccgaaccctaaagacacactttgaagtaagggctcagacagatgccggtttctgtcactcctgtctagtcaaccctagcaatgagatcctaaaagccataggtcaagatattcactaatgaaaacagctgaatgactcaaacacccacccataggacaagccacaaaaactgtttacttagcccctggaacagcaagcagtctcagtgaaatactcaggcaacccaggccaacgcagaatgctctcacagacacacaaggtaaccactgtgacagactaatacggtcacaggagctgttctctagttcagtttctaacagtgtgttttggaaacaggaccacttctgtgggagagccagggcagactattgcctcctctgggcaatgagaatgctacactgtctgaagacggaccagtttctcgaatagcccaggctggcctcaagcacgggagcagctgaggaaaaccttaaactcctgatcctcacacctctactttgtaactactgtcatcacacctggctcacagcaacttttggaactattaaaaataaatcctgaggattggcagagtgcttgttcagcatgcacgaaatcctgggttcaatccccaacagcatcaagtaggcagtgaccagccagggacacatataatcaaaaagtcacccctaaaacaagagcccggagctacaactgactttctgctctaaatctgttttttacagacctaatgtctggtactacatacttcctatagtaaacatgtattatgtgcataatgggaaaatttagcttctagttgttactgtcttgtaacagggtctttgtagtacgggctgtatcctcattcttgcctgcctgaattataagatatgccaataaaccaggatagactgttggtattttgatatatttttatttaattagttcactttttaagaactttgtgtctgtatgagtgtatgtgaccatgtgggcatgggcagcagacaccgtcaaatccctcgaagctggagttacaggcatctacaaccccaatgtgggtgctgggatccaaactctagctgtcataatagagcaagtttacttttaaaaagtaatttacttttaaggcaagattccactatgtaaccctggctggtcttgaacttatggtaattctcctgtctccgctttccccttacaggacacacacacacacctgacaaggtagaggtaggcaggcggggcaaagaggaatgtctgaatcgaatggagttctgtacacaggaagcattcaacaagttcttactgggtggaagccaagcctgtagcttattgcaaggactgcctcccccccaccccccaaatgccagagcaaagtcagtagagcaaaatctggatttgcattcccggcctttggctccaggatgttgtcagcctctcccacagaaaatgtttgctggcccttaagtaccatgggggcaggggaccctgaactatctctacacctagcatgcagtggggactcactcaactggagtgagtggaatgtttgatcaaacgcagactgtctgcccaggccccaagctccaacctgcaggcacaggcccctggaggacatggaagacaagccagctgacctaccaaatacaagccgactgtcactgggaggaagggccattaacaatcaggaaataacactccctggctgaatgaggaaagttccaccatttctgggcttcagcgtccccatctcttaagaagggtcaagggtcaaaaagtcaggttgccaacagggttaagtgggtgaagtgcttagcacagagcctggcacacaaaacatccttaaacaatggaagttgctattgttattattattagcatcttggtgattccggaaggaaggcagcactgggcactgggccaagggggctatgggccttcccaagatgccgcagggaccagctgccacccaaaaccccatcagcagttgaacagctagctaccctgggttctgggccctgcccctcccatttgctccaagccccctgctgagaaccccctccagtcccctccaccctcacaataaagctggtggcccacaccctgcgcccgccctcccgcttggatccaagttccaagcttccactctccactgactcagctgccttttctaggcccccagcctaaactggtcttgagctacttgacgttcagggtaagtgaagactttttccagggatctccctcccacctcttctctctccaggaacttgagggcccttccatagatctcaggggcccagcccacccagtctttcagagtctccggggtctgcccgcctgattaataaagttccatggcaaccaggggctggaagggtggcagatggaaggacaggcagaggaagggttgcagcagctggcccagcaccccgcccccgcagagaaggcctcccagtcaggaggcctatccccagaggccgggaaagctaggccagcacctggcactccaacatcgaggcactaaggaggggtctccccaagtcacccttcttcacctcccacgtgcaactgtgctcactacccaggagccctaagttctgctgcaagccagcagacatcacttaaaataccagcccccaccacctgcagctgcgtgaagcactcacttccctgtctgggcctcagttcctccctctggcagatgggcacgtgacaacacccagctcacagcagagttgagaattctggccacgatcctaagtgtgccaaaggctgggtgtgcactaagcaagcaccagctgaatacacgtgaaccattatctttaacgaatccgacactctggtgaggacgctgaggcccagagcaaggcgcagaaaacagggaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgatgggtggcggggtctggcgaggggaacaaacttcgtacttggttctgcacgttccgcagtcccccatgacacatgacccctggactcccaacctgtggcctccaccccctcagctcatattccagaaactgtctcttctgcacgctcaggctcacctccaaagctcgcttcagccacatctccggtcctgctccatttgctcacagatcatgggcccttccctatccctgtcacctagaagccacgcccaagagggggtgccagtaaataggttgggatgtctggctttgatctcaaactgattttagctgaaattccttcagtagctagcgcccagtttgcgttcattcatttgcttacttcacacgggctccttcctgccttcaatgccagcacttgaggagacagaggcaggcgggtcttcaggccagccaggcaggactacacagtgagaccccatctgagagcctgttcagtgccccatcctcagtccagaccttactcctgccagtgaaaaggaaagagggaaacaggcagcagaaacttccaatgtgaagagactcgaccattaaattaactctacgttagacctcacgtggggcggtagggccgtgcaagggcggtgaggatgcctgtggatggatgcgcgtttactactgaggccctgggctatctccgtcagcatttctcattgctcaggtcagcccatctgaccagtattgtcctctctgctaggcattgtgccaacactgggaacagagattcgaaagatttaacaagacctacaagcttcctgcactggggcggggcgaccacaagaagagagtagctgacaacattcaagtccccaagtccagtgcaagcattgcttcctcgagggagctctcaacccagggttgcttattccattgcctcatactactttttcctctgcctcaactctgaccacactgctctgggctgccctagcgggggctgtttctcacaccctttctgggtatgacagaaatgaggctgagggcagaggagaaccggaaagcaacaaggaggctgtgatttccaagctttctgaaatgccagggcacctgttaactttgggtcaccccagctggccaatttacaatcaatccctacctcccacccaatgccccccccacaacctcttgggtttttttgtttggggatttgttttgtttgggtgatttgagtttgttttttggtttggctttgttgttgttgtttagagacagggtgtcactatgcagctctggctccctggaactcacaatgtagaccaggctggcctgaactcagagacccacctgtctctgagtctcccaagtgctgggagtataggggtgcaacactatgcctggctcaccccttggtttttgtttgtttcttttcttaagagccagtatcttgctgtgtagcccaaactgaatcaaggtaatcttcctgcatcagcttcctgagttacaggtatgtgcttcctggattacaggtatgtgccaccacacccaggaccagtttagaatctttatgagctcaggaatgtgcattttgcaatagacttcttcttcttcttcttcttcttcttcttcttcttcttcttcttcttcttcttcttcttcttcttcttcttcttccaagcgacttcttaagaaatacatttgtatttccagtatttagaaggccgaggccagaagagcttaagtcccagggcagcctggtctgtatacagcaaaaataaataaataagataaaaaaaacaaacaagaaatttctggacagtggtggcccacccctttaatcccagcactggggaggcagataaaggtggatctcagtgagttcaaggccaccttggtctacaaatcgagttccaggacagccaggaccattacacagaaaaaccctgtcttgaaaaacaaaacacaaaacaaaaccccaaggaacacttgtatccatcccagataatgtgttaatcttcaaaaacaaattggtatacctttataataaacatgtggagtggagccaaaaattacagtttctacagctgaatatagctgctttcacctgtgaccccagcagataggtgcagaaagaccaggagttctagaccatccttggctacataggcagccgggactacatgcaatcctgtcttaaaacaagcatattgaagctctcagtgatggttttcagctcagtttcttgtggaaagtggacacctagatcttgccttggccacttcaagttttcctgagatgaaggcgcaagggactagacagtactctatagactgtgaggtgctttggaaaatagcaagggtgtctttccatccccctctcatgagcagtttgtgaaattactcattgcagatcctggaatgtgtcagagctgggaaggaccatgagagcacacgagcccttgctgtacagatggggaagtgaggctcatgcagggttagtgcttgtgaacccagctagtgacagaatctggcccacatcagatcctgtccccacgtctgtgctgcccaccccccaccccacagtagagaagcgaagggctagatctcattcaacataaccaagccagacactgacggagggtgagagaggttggcacattctcgttccagatggagtgcttcccttctctgggcttcctaaggggcccattaacaatgacactcgcttttgaaaagccttctgctactcaatagtcattcaacaaacacttactgaacatctgttatatatcaaggatcaagatggttgctggaggggaaaacataatattgtcccattttatgatgattaaactgtgcttacctagtaggctgaaaggctatactacccaaggttggagaggccaagaccaggggctttgctaggcctcaccctcccaaaatattcaactatacatcctacacaagcttacagtcacaagtgctcaggaggttgccacagatcacttgattctggggattcaaggacagccgggccacagagggaaaaatcttaacaccccattataaagagggggtagatcttattatggtaggcaaggagttgcacacctttaatcccaacactcaggaggcaaaggcaggtggatttctgtgaattcaaagccagcctgatctacatagtgagttctaggccagccagagtttcatagtaagaccctttcttaaacaaacaaacaaaaaacccaaaaaactcaagttcatatccaaggtgactgagggatactaattcccactagccctcatgtcctgagtagcagaaaggagtatggggtgaagaccagaattccctgaaggaaaatgaggataagataagggctgttggatctgttaataaatagtgggcagctgagaagggcccgagagatgggccctttggccaagagcctgaagatcccgataaggctgttctcaatgtcagcaggtctcctgaggcccaccagcatccaaaaactaatccaccatcactgggtagtcactgcaattagtgtctcctttcaaccttataatcccataagtgaagcttgtttatctgcaggatgcggaaaggaaaaggctcagagagggtccctcacaactcaaggtcacacagcaaactgaggtgaaaacttagcctgttcctctgcaaaaatccagggctgcccttgatatttgtcattctctattaatgtcccaggaaccaggatcaggatataatgtgtggtttccaaagggtattagggaggagtctggtttggttagtaggtacctatatctaccaccatctataccaacctcatctaaaggattccaaggaagtggtagctcctggccctgtgtcttctgcctggagacatcttgcctttggttctttctgagatgaaaaatgggccaggcagtggtggtgcactcctttaatcccagcactccagaagcagaggcaggcagatctttgagtttgaggccagcctagtctacagagtgagttccaggacatccagggctacacagagaaaccctgtctcaaaaaacaacaaacaaacaaaagagatgcaaagtggtgtagtagtaagtggccagacctctcactctatacattcagtagacagacataagcaggaatcctgggctgtgtgaccaaggttcaccttatttccctcaaaatgcactcatttacaccctggatatctactgaacacctagtgagtgcttgccattgtaggagctggggagacacaagcaaagcagatgcatggagacacctggagcctgcaagctgtgcaagactgaagaataacttccatggacctgaacaatatgcccattaagaagtttgacaagtgacagagataatttaaagctatttattccacacaaacctcccataaatatacattcttagcttgaaaaaaaacctctaaacacgagtgtcccatcattacaaggaatacataattaggagaaatgtctctatggtgacttcatgttattaagggcacagagacatccattgttgagtcctggcagaaggcagtggggaattttgcatctgcgattcctcgttcctcttgagtgatcccaggatgctacactgactggcagtttactgtccctagagatgttctgtcaccatgccagctctagttgagtaggccccctacccactggagaggtagtctcatacaatgctggccttcagagccagcagaccccagctcatccctgctggaagggctatgcgtgcccaagccctgcaatgtgggctaacagttctaagacaggtgtcagggtcgaatgaaggaacacagcaaggagagttttcaaactgaccctcaggatggtttaattttaaaaatgtaagcacctggttttctaataaaaccagcaagagagtctggggctgtaactcactggtgagcatgcttgcctagcatgcacaaaaccctgggctccatctccatctctgcataaaactccttatggtggtacacacctgtaatcccagcactagggaggcagaggcagaaggatgaaaagtgaagttatccttgggtatatagcaagctcaggggtagcctgggccacatgcaaccctgtctcagacaaaattaaacaaaaacaaaatctgtcatagttggcaatattaaccaggccatcaaggcactaatcagttcctgtgtcattgtcctgtgtcctccccactcccatcaccatactcacttcctggcttgccttgctccatgactgtgaccatacttgccctgatgttccaagtgagtctgcaactcatagtagtgccttgtgggatacagagtaaatgtcacaatactattgatacaatgttgaatgggcaccaactggttggttccagcacagcttctctcctcggtgtgtcatgaaggacaaggtacagatatggtaggatagggaaggaaggcatttctggggtcactgtgcagctctggccatcagtcagcccttatgttcagtgggataaacttctgaggagacagggaaaaccatatacagtgacttcatgtttgccctgaccacactgatgaggtaggagattctcagagccaatggctctgattcttcatctgtaaatggaggtaataagataatgataataagaataatgtttctgatagggctgttgccatagtgaatgagcagccggatgcgtcaaacagcacctaatgtgtgaagagtgctcagcgcaatgtcaactgctgttaagtatgaagataaaagccgggcataggtggcacacacctttaatcccagcactcaggaggcagaggcaggtggatctctgtgagttccaggccagcctggtctacagagcgagttccagaacagctagggctgttacacaaagaaaccctgtccagaaaaaccaaagcaaacaagtatgtgctactcttccagaggacttgagcttggttctcggcacccacttagttaggtcttctcgctgtaactccagctctagaggatccagccctctgtgaacacctacacctacacacacacacacacacacacacacacacacacacacacacacaaataaaataaaaaaattgagacagggtatcaaaatgttcatacacacaaaataaaataaataaatctaaaaaaataaacctccaaaagtaataaaagaacggagatgaggccagtgaaatggcctgctgacaagccttagaacttgagctcagttagcagaagggtccctagaacccatatgaagaaaaaaagaagagaatattaaccccacatacacaccccaccccaaaaataagtgttaaaagtattttttcaatggttgtagtggcagcactcaggagatactggcagaaagatttctaaaaatttgaggccagtttgtctacataatgggctccaggccaatgaaggctatgtagtgagtctctttctaaaaatagatgatagagatatagatatatggctacggatgaataaaatggagatgagccacttccaatggaagtgtaggagacggtgcacatctgtaatctcagttcttgaaagacagaggcaggaaaatcagtaggtcaaggacagtattagctacatgctaaattcagtgccagcatgggctgtacgggacccaaactcaaacatgaactcatgtctacacacacacacacacacacacacacttacttggtggagactgagacagtttctctaccttctcattttgaggtttccataaagaaaaagaaaaactactcttgtccacctggagaacaggagagttgttcaaagtagcccgatcctacctctcaaaccctgtgagtcagacaggtccagagacagggagggggaaatatatttggaggacaatggagtgtggcactgagatgaaccctattccactgatcctgggtcttttcttgggggcaggagagagacaaagggttttatgtagctgagtatgaccttgaattcctgattctctggtctccctgctcctaagggctaggattttaggcatggacaccatacctgggtcctgaaacattttcatattttaacatctccagcccaagctatctctccagccccatattttaacatctctgaaattctttatctcccctcttcctttctctctcccaccctccctaatctttccactcctcctctcaactcaccctcctctaatacccacaccctccccctcctgtcttttggtgctgagaataggaaaccctgtgaataccaaatgggagacagtgctctgtaactcagctatacctccagcccctcttttcctttttagggagtcaaaataatgatgtactctagatcttgaatggcttcttagaggtggttagctacagttcacatcagtgccaggtggggctgggagtgacatcagtgggagaagccatgctcgccctacacaagattctggtttccattccctgtgcagggccagcacttgccatgtcataagcccttaggccaccaccatggtcttcagcatcaatgtaagccggccacagtggagcaaccagcttttctctccttttgtagctgacacctgcactgggctccagatgtcatagacgaatgacacctgcagctacgcaggagaggggagagcagggcagggggaggaaaacacttcttataattttatattaatatattcagaggaagagccagagccctccagccccccctccccgcccacacactatttttaaataaaaaaaaaaatcctctggaagccagagttatatatatgccaaacaggccaggaaacccagcagggcttctggggctgtcaatgaaccgaaacaggggcattgtgtccaggccactggctggctgagggggcattgttagggcctggcctcgtctgggaagaggggggtgaagagggcagggggagtgtgttcccatgactccctggggagcaatgacaatcagggccagctgcgaagcctggcatgccaggggcctggtaggcggctggcctcaaaagggccatgaagggcaggagaggattgcagaggaacagggaggggcactaggtcctgggactatctcttggctggaggcaaactccaaagcagagagacatgagggttattcactacaccctcctctctctcacccttcctgagcattgtgccattctccaaggacaccccagatcctcccactcttccttcaccctggtccaggacacccttgagcgacttcttgctggcaccctgagctcctgtgttctgttcttcattggaaggtagaaaagtctttcccaaaggtaactaacatcacactgcattcccttgcttaggtccagtgctctccctaagcatgtcatgctcaccactggtatccagggtgatggttaggctcatcatacctttaagtcatacaagggtaaaatgggtgatttaccaatacgtagccaggtgaagattaaagtatttaatagggagatgccttacttactgagcaacctagccagccggctgggatcaaagtaaatagggcaagcctataaggcagggaaaagagagagcataccatgtgcattccctaacctttaaacctctcccatgacaccctgacatcaccttgaccacgccctgatgggcgtgatcgggcacacctgtagccagccattaggaggcatggttactgtgtccccctaatacaagggtttttgtttttttggtttggattttttgttgtcgttaaaaaaagggctcactatgtagtccaggcctgtaacttactatgtcttccagcctagcctcaagtgtgtggctctgcctcctgagtgttggggttacaagttcgtagcaccatgcctgggcttttttctttcttttattattttctagcttattggctgtttttgtttttctacataggttcttatgtagagtggtggttatgcacacctttgatctcagcacttgggcagaggctggcagatctctatgagttcaaggtcagcctggtctacagagctagttccaggacagctgggcctacatagagaaactctgtctcaaaaaacaaaaacaaaaaacaaccaaaaccaaaatcctaaaaaaggaaaagagataggaccttgctactggcatgctatggcctcaaatttgtgatcctcctgcctcacctcgaggtcctaggattatgtatacatttttaaagattttgttttgctttgtttatatttgtgtttttgggatggtgtctaattatgtagctttggctggactggaacttgctatgtagtccaggctgctctcaaacttgcagagatctgccttcctaaagacgtgggtcactgctccatgcctggtgatttattcttttcaattagtgtatgtgttgggggcggtatgtacgtgcaactacaggtggccagggatgtcagaagcaccagatcctctggagctagagttacaggtgcttgcgaatcacctgatgttggcactaggaattgaacttggatcccctgcaggagtaatacatgctcctaacagctgagccatctctctagtcctgagtcctgagattatagatgtgtgtgacagcaactactagattttatttaatgcaaaggaggagaagggggaagaggaagaggaaggtatattgtgttcaactataatccagctcttgggagacagaagcagggggatgtctgaattcagggacagtctggtctaacacactgagttttagatcaatcaggtttacatagtgagaggctcatctcgaaataccaacaacaatgataataaactaaaataataaaaggaatatgtattcataagtcacaactggttagacaagtgacaagttctataccactgagctcttgcccccgcccccaaaaaagaattttgttgttgttattgtttttgtttttgagacagggtctctctccacagccctggctgtcctgaaactcactatgcagactaagctggccttgaattcacttcccctctctccactgaatgctgggatttaagatgtgtgccatgcatgactcccagccctcaaaatattttattgttaattttgtgtatgtctgcgggaaggtgtgcctgtgagtgcagttacttatggcatcaggtgtgagtgctgggaatcgaactcaagtcctctgcaagagcagtgtaagctcttaaccactagccccccttggttttggttttggtttttgagatggccttatgtagtccagactggctatcctggttggttttttttgtcaacttgacacaaaccagagttatctagaaagaggagcctcagttgagaaaatgcctctgtgacattggtctgtgggtgtgtccacagggcatattttcttgattaatgattgacttgggaggggccagtgccatccttgggcaggcagtcctgagtgtatgagaaaataaactgggcaaactatgggaagcaagccagggggagcaagccaggggcagcataccttcatggctttcccttcagtttctacctttcattcctgcctgactacctctgtgactgggtatgacctaagtagttgttagatgaaataaacactttcctccccaagtcgcttttggtcatggtgttttatcactgaaataaaatctatgacactggcctcaaattcactgtgtagtagaggatgataatgaagtcacgattcatcttactttacctcctgaatgctgaaattacatgggcaacagaacttacagctcttccaggactggggatggagctcagatggtagactgcttgtcttgcaagtacaagggttcaaaccttagcactgcattcacaaataaaggaactcacagctctgcctacatgtcccttgcttgctgccttatctaagacactgcttgtgtttattgcatctttgaaggcatagtttttgaatattctattagatcttagtatttttttgttttattttgttttgaggggagtgttttgtttgtttgtcctggctctgtgtacttgcttgcatgggttttggaaacaactctgtgagaggggatgacaggctcctacagatgccagaggaattcatgacataaacaaaggcactccaagagaagtatctaaagagctgatgtggcctggccctggtcctgactctcagctgacacccagcccacacggagaaagaagcctggaagagtgaagagaacaaagattgtgacactcacgccaggagccacatgcagccctgcctgctttctatcttagtcacgacttccgcaggagctcttgagcagagtcctggtgcagaaaaaccaggatgcctgtgtttagaagctttcttaaaccgacactcagaagagagctctgcttccctttgtcctctgcctgggtgtgtttggcctcttctgcctctgtttaacgtcaaaactctcactccaaaatgcccttcaaggctgaagtaagacattctctccctaggaatctgaaacaagacaagggaaaggggaaaacacttttctttttataaatacgatctaatttgtcaaagaaaaggacatctgaagccacagtttgtcgtgacatggccttccttctgggaggcagaacatggtgttctagtttaggagaccagagggttcaaagcctgcttcttataaaccaaacgcacttccagagcggtaaaggaacagtgtgaaaagagaggctgttgccaggaccctttctggagcctgggcgtggagtcttgagaggaaaggatcaaacacgggcagcttcttggcatctcagtctgcacattgttgctctcacacgggcttacttaacaatctctaatctgggagtggagaagcagaagggtcccaaattaacgtcagccttccccttcacttggaagtcttgagagcctgaattttgggaactgtctctgataaggcccagggtatctggggtggttctttattgctcatcatagtatggccctgctcaaggtatcagaaaagtggagctgggtgagtgaaggtacgggctcaaagaatcacttaaaaagatattttttttttttggtttttttgagacagggtttctctgtgcagctttggagcctatcctagcactcactctggagaccaggctggcctcaaactcacagaaatctgcctgcctctgcctcacaagtgctgggattaaaggtgtgtgccaccaacgcccagcccttttcacaatttttaagagttctcttggatagctttctgtctaggctgtttcttgtgtgtgtgttggggggggttctcacagaagcagtctatgtccctctttcttaactctaactctgcagtcatcgatactactgcaaaagtagcttccttgctctttatagtcaatggaagcatggatcatggacttcccgtgatttcttgtgacaacacggaccatggatatccacatggtgtctggcatcaaaaagtgccacagacctcagcatggtcttctgtggtggtacagaccacagatactaacatggaccacagataacatcatagcccttagtggcagcacaggtcaaggatatcaacatggcttctgggacaacagggcccatagacaccaatatggtccctggtagaaaaaaacattttttatagctatgggtatatgttttatagctatgggtgtatgttttatatgtaggggtattatgtctgtgtagtaatgcctgagagggccagaagagggcgtcacatcccctggaattgaagtaaaggttgtgagctatcgtgtgagtgctgagactcaacttgggtcctctgaaagaccagccagtgttttcaaccacggagccatctctccaacccctcaatggctcactttctatagaatattttgttgttttaaagccagaggtttttttgttgtttttttttttgtttttttttttttcactgtgtagccctctggctgtgtggaactcacactgtagaccaggcttgcctttgaactcacagagatccacctgcctctgccttccaagtgctgggattaaaggcgtgcgccaccactgcctggctagaatattaatcagaaagaagccaaacacaaatatgaggatcaacgtcaaaaaagtcaagattaatgcaacataaaggtttatttgtagacagagtagtgatcatacgtaggacacatcagaagactgtgtcgttcagaaagtgctagaacccaggggtggggcaaagggttaaaggatggctcagtcggttaggagcttgcatataagcatgaggcccaaagtctggatctccagcatccatgtatacgccaggcacagtagtgtgtgtctgtaatccctgctctaaggaggagagacagggagaagcctggagctcactggccggctaacctaactgaaccactgagaaagagaggctccacctcaaaaaaaaaaaaaaaaaaaaaaaaaaaaaaaaaaaaaagtggaaggccaggcttttgtggcacacaactttaatcccagcactcaggaggcagaggcaggcggatctctgtgagtttgaggccagcctggtctatagagtgagttccaggacagtcagggatacacagagaaacatgccgtcccccgcaaataaaatggagagcaactgaagtaggcaccgaatgtagacctctatcccccacatgctgacacacacacacacacacacacacacacacacacacacacacacacacacacacacgcatgcatatgcagactggggtaggtattcttatagctcgtttccctggtactcaggacccagcttaggtataggagagagtcaaacttctgttaaacagcttgatgtttgtttgtttgtttttgttttgtttgttttctaagacagggttattgtgtatccctgcctggcctggaacttactatgtagatcaggctgttctccaaactcacaggcctgcctctgcctaccaagtactgggactaaatgagtgcaccaacctttgagttttgtactaaggagggagggggtgctttttgagacagggtctctcatgcagtgctggcttctgcctctgaaaaggaggatgacaggaacgtacaggaatacactgccatgcctaactttggctatacagtgagttgcaggtcagcctgggctatagagtgagactgtgtcaagaaaaaaacaaaaagcccaagcaggatgacacatacctgtaatcccagcattcagcaggtagaagcagaaggatcaggaattcaaggccagcctcagctgcatattgagttcaaggctagcctgggctacatgataccccgtgttaagaaaacaaaaccaagactcccaaaagggagaaagttaattaaataataagataatttttaagtccggcatgtcaaaagactccatacaaatgtggcaggcagtaattgcagatttatctaccttgctgtttcaggaagtcccattcaggaatggcagtagctcctccgtgtatgccaatggttctttagcatttcctacatatagatcataaaaatggaggcttagctagggaagagtgaagctgggctcttcccaaagctgctgaagacaggatctgctcctctctgtggggaccaccccgccttcctccctggagtgtgcagttggaggcaccagatgctctggcaagatccagagagatgccatctgcgagggaagcctattcttagagagcagaaccagtcagtggtggagccggccaccccccgcagcagaggggggatgtcagggcaggaggccaaggctagctggggagaagggcaggctaaacacagggcacacttatttcttacaaccagctccctcctgcatttgctctattggaaataagagcaatgtttgttgaatgttcacttgtatgtatcactcaaaccctccagacaccacaaggtgtgtgtcatcacaacgcctctttacagatgaggcacagatggctacgtcactaataggtcaggcctcaagcccaggcatgctggttccaaagcccttgtctcttgcaaccatgtatactgcttctcagtggccaattttagtttgggttacccagataataaaccccaaggtgaggatttgaaagcaagtgctttaagtgagaagtggtcccaggatgcaaaggctgaggcatgagggagatagtttccatgggctcctgaagcccaatccttctggagctctagcaagcagcacacagagtatatgggggttatctcctccaagggctgggaggtgctcatgatggctcttctcagtgctgggttaatgctgctcaaggggcatgtcagtccctaaaacttcatgcctgctgcagagtggtaaagcaggccccagtggtgggagtcctcagacagggaaacacaggagtggcaactggagaagtcgggtgttcacgcagagagaatggcagggctccccaccatctgctataataaacctgcctggcaatggtcggcctccccacagtctcgagtttgctcatcaagcacagtaaaaagctcttccaaatggtctgctttgagcttacagtgagctgcagccgagagcactgggaagtcagacaaaagccacctccaccaccccagagatacctaggataatgatgcttggccctgctgttcaccactcgctcagtactcaggctgggctcatagcacagcacttacagcataggaacctgtaggctataatagttccaaaactattccacacccctaagtcagaatttatattgtgtccatttgttgtttatttttgagacagggtctcacatgggccaggctggttcccaacttgctatgtagcggagtataaccttgaactcccatcctcttgcctccacctcccaggtgctgtgaatatgggtgtgtatctccatgcctggccataatctacacactaataagatttccagtgactcatgtagatttctaccagtcatttcaaacacataaaaacacaggggaggaagggcacattaaagtaatgtattgcactaaaccaagggtctcagactggcagcctctggaccaggcttttccgagagttgttttgttttaaaaattctgcctgcagccgggagttggtggcgcacacctttaatcccagcactcgggagacagaggcaggcggatctctgtgagttcaaggccagcctggtctccagagcaagtgccaggataggctccagagctacaaagagaaaccctgtctcaaaaaaccaaaaaaaaaaaaaaaaaaaaaaaaaaaaaaaaaaaaaaaaaaaaaaaaaaaaaaaaaaaaaaaaaaaaaaaaaaacccctctcaaaaaaaaaaaaaaaaaaaaaaaaaaaaaaaaaaacctgcctgccacacaaccacacaactctctagttcactgtgacacatttcctcctatggcatagcacctcaagaacatccatttaggagtttgaatttgtggctgagcttgaagcacctggaagcctagtctgccaagttgtcgcagacgcttctagagaattacccaggcattcatgtaagcaggaatcaagataactacagtgtctgtccctgaggaggatttatgtcactataagcaagtagttgttcgtatgcatcctgagaacacaaaagaaaaggcagttgtgtcccacaaagtggttcatgttgtagataaacatatactcgcttttgatccaaaacaagaagtcagttttttcaagaaaagaaaactacaaattttgatattactaaaaggcaaaataaagatcttaagtttgtatttgatgctgtttttgatgaaacatcaactcaaatggaagattttgaacatactactaaaccaattcttcatagttttctgaatggagacaattgcacagtacttgcagatggtaccactggagctgggaagacacacatgatgctaggatcagctgctgatcctggagtaacgcacctaacaatgttagaccttttcaaagccatgcatgagcctaaagaagagaaagtgtgtagtactgctgtttcttatttggaggtgtataatgaacagaatcatgacctcttgacaaatttggggccacttactgtccaggaagatgcccccaaaaggagtggttgttcaaggtctcactttacaccagcccaaatcctcagaggaaatattacagctactaggcaatggaaacaaaaacaggacacagcatcccactgacatgaatgctacatcttctcattcccatgctgttttccagatttatttgtgacaacacaaataagaatcaatcaaaatatctgtgtagccaaaatgtcactcattgacctggcaggatctgagcaagccagaacttctggtgctaaagggacatgatttgtagaaggcacaaatattaataaatcctgtttagcccttgggaatgtcatcaatgccttagcagatacaaaaagaaggaatcagcatattcctttacagaaatattaagcttgctcgcttattgaaggattctcttggaggaaactgtcaaactgtaatgacagctgctgttagaccttcctctttgttctctgatgacacatataacactcttaagtatgctaatcatgcaaaagtcattaaacctttaaagagtgatgtccttaatatgtaaagatctgtaatgtgcagaaaacagagattttaatgctgaaagaaaaactaaaagcctatgaagaacagaaagccttgactgacaaaaacaacagtgtaaaatcagtacatcaaacactcaagacaaagaaattaaaagacttcaagaaattcggaaatgcttgttccagagtcgagaagaaatcaggcaagaatatctaaagttagaaatgttgcttaaagtaaatgaactcaagtcattctatcaacaacagtgccatcaccaaatagagatgaagcattcagaagacaaagtagaaaaggccacttgcgcccagtggtggtggcacacacctttaatcccagcactcgggaggcagcagctgctggatctccgtgagttcgagatcagcttggtctacaagagctagttccaggacagcctccaaagccacagagaaactctccccccaaaagaaaaagaaaagaaaaggccacttgcaatcgagatcacagacttcaaaggttgaaaactgttcgctgtttcctagagaaaaagaaggaagaggtgttgaaacaatttgacgagaataccaattggctttcttaggtcaaaatggtgacatcccagaggtactcattaaagatcttcattgtcaccaatatacctccagaccaaagacctgaaaacacaaatggcacacatgaaggctctagcctgtctccaagagcagcagcacagtcagattgaggcagtattgaatgttttacttccagccctaagaaaaacgtatttcatgtcagaagaaactaacctgtctaacgctgcttttgattctgacttctgacttcaaagatattgagcatttggtagaaaggaagaaggtggtggcttggactgaccaaactactgaacattcaaaccaaaatgatgttccagggatttctcttcttttttttttttttttttttggtttttggagacagggtttctctttgtagctttggagcctatcctgcactcgctctgcagaccaggtcagcctcaaactcacagagatccacctgcctctgcctgccgagtgatgggattaaaggcatgcgccaccaacgcccaacgggatttctcttcttatgaccttcccacagcttggaccaatgcaatctattccttgttgcatgtcctcaaatgaacctgacttgcttaacattactccacaaaaaagaaccagaaggaaattaacaccatcttctttgaaagtaaaacatactgagaagtctccactgtctgaaagtacaagctcaatgattctttcagcaaagaacttgagcctattgcttataccccagaggactacagaagaccttttcaaaacccatccccagccttaataaaaccttcatcacatactacaaataatcaatgataattctcatggaacactgggataaaacaagttggagtgtgaggcccgtggctttgagaaggcaggatcctccgtgagggtgtgttgatagaaccacactctgagcagcagctcacactgcctggaagctgtctgggcagaggagttccttaagcaccttgggctgtgttacttggaggggcggctcttgttgaagatgaggaagtctgagatgtcatgccacacgttgctgtcctcgtagaggtaggtcatggaggactgcagtgagggctgcagagtgggccggtgatactcaaagagccatagcacaagcccccaaatcactgctgtgtgcaaggggaacgggtcccagctgagcttagggatgtagcccttctccacacccaggcggcacaaggcaaacaggacgcgtgatgtcaggtacatgttgatctgcagggagggaatgctgagggttactagtcagcatggccactgggaaccttcacctgcccacccaaccctaggcactgggcattgctgtgcagcggctctgtgattttcaaagttaacgtgcaagatgattgaggtggtatgcagcagacattttaatatttctatttatgtgtgtgtggtgcgtatgtctgtgtaggcgaatatccttgtgtgggttgggtgcttgtgtacatgtgggtatagagactagagactgcaattaggtgtctctctcagttccttctctggcctaattatttgttttgtttttgttgtatggagacagggtctccctattatgtagctttcctagaacttgctatgtagaccatgctagcctggaactcagagagatccacctgcctgtcttctgagggcagggattaaaggtgtgagctaccatgcccagctccagccaggtgtaattggtcaggagtggtggcacatgccttaagaggattgagggccaggtgactgtggtgcacacctttaattccagcacttgggcagcagagtcaggaggatctctgtgagtctaaggccagcctggtctacagagcaagttccagctgaggctatgtagagagacccagttttaacagcccctcccccaaagaaacctttcaatttacaactgttttctctttttaaagatttaaaagcactcttaatctttgagctataggtccattctgccccttacccaatttgttgagaccacagtttctcattcaacacggagtgcaccaatttggctatgctagctgactacagagttccaaggatctacctctctctacctcccaaatactgggattacagacagatgcttctgtgcttggctttaaaagaaataggtaataattattatttatgtatttactttgtgtgtgtgtgtgtgtgtgtgtgtgtgtgtgtgtacttacttaactgtttttcctcagaaaccattcatcttgttttttacttttttttttttttttttttttttttttttttttttttagacagggtttctgtgtgtagctttggagcctatcctggcactcgctctggagaccaagctggcctcaaactcacagagatctgtctgcctctgcctcccgagtgctgggattaaaggtgtgcgccaccaacgccccggcgttttatacatttttttatttttgagacaaggcctctcatagcctggcactcaccaatctggatagagtggttggttccagagagcccaggtcccctcctgcatctgcctccccagtgctgtgatttcaagtaccatagtggctggctttctatgtgtgttttggggatggatgtcaggtcttcagtttgcttcataagtactttgccaacagaacgacctctctgttccctttttagaagctgtggttttgttttgttttgttttgtttcaagacaggatatcactatgtagtcctgactgtcctggaactcactaagtagatcaagctggcccaaaactcagtgtctttgtctctgagtgctgggattaaaggtgtacaccactatgcttggctcctttattagaagtttttaaaattgtacacagttcaaaattttaaaaaatgatccataagaggaaaaataatattttggatttccttgaaactcattttttctatgtgaagccagctgggtatacagaataaattccaggccagttggggctacaaggcaaggccttatctcagagaaaggaaggctacaaggagagccattcacaatacatatgtgcaaagcatcagcatgtaaatgttctgaaaagtgtcctcagggctcacaagtaaaacatgaaacattccagctggaaaatgagcaaaagatatgaatgtttcactcgatgggtagcaaataagtgataatgaggaaaatttcaacatcattgttcatcagggaaaggtgaagtcaagtcacaatggataggacagggctggtgagatggtttaggagctgagggcacttgcagcaaaagtctaacaacctgaatttgatccacagagcccacagagtggaaggagagaaccaatttccaagagctaacctctgaatcacattcatacaccatggcaggtgcacacctgcacttataaacatcacacacccacccacccatacatcccaaaacctttaaaacatagataaaataaattgtgaagcaaaccaaatgttaataggatatggagaaactagacactcctatatttgtggtgagaatgaaaaaaaaaaaaaaaccatagtcactggaaaacagcttggcagaggtttgtcagtttctttctttcttcttttttggcaggttgttttaaaatcaagcatgcatgtaccatacaacccacaattacactcttgggcttttatcccagaaaaatgaaaacttatgttcacagaagtatctatacaagagtgttcttcacagctctatttgtaacaccctaaagctagaaactgcccaaatgtccatcagaggatgggaaaaaaaactgatggtacttctatactacttaggagtaaaagggaaaaattaagccagggtggccatacatgactataaccccagtgctcctgaggctcggggggaattgccaaggctcaaggccaacttgggctacagagcaagacacagaaaaaaaaaaaaaaaaagctggttgttggtggcatgtgcctataatccaaaccccggggaagtataggtaggaattcaagttcagactcagctatagattgagtttgagtcaacctgggcaacatgagaccctgtctcaagaaataaaagggactggaaagatggttcagaggttaagagcatttgctgctcttgcagaggaccaggcttggttcccagcacccacacagcagctcactactttctataactcatgtttcaggggatccaacaccttcttctggcttctccaggtaccaggcatacatatgctgcacacacatacatgcaggcaaatactcaggctcataaaagaaaaaaaaatgttttaaaagaaaaagtcaggctgtccttcccatgtgactctggcatttttttttccccaaagaagtggtctattttttgtcagccaagtttgcaaaaacagaattagccataatattccatagctttttatttttttttttttttttttttttggttttttgagacagggtttctccgtggctttggaggctgtcctggaactagctcttgtagaccagaccaggcttgacatgaacacccaaagatctgcctgcctctgcctcccgagtgctaggactaaaggcatgcaccaccaccacccagccaatattccatagcttttaaaatctacatttcatttactattattttattttagaggtgcagggaaaatatgtgatagcatgtgtaaagcagtcagaggaaaacctttgagacttgtttctctctttccaccatgtgggtccccggaaccacactaagtcatcacacttaatggtaggcaactttacctgctgtgccacctcacaggccctcagtgcttgtgctttttatctttatttttgtgtttgcttatttattatttattatttattgagacaggttctctctatgtagccgtggctgtcctggaactcactatgtagaccaggctggccttgaattcacagatatcctcctgcctctgcctctgcctcctgagtactggggttcctcaaggccttttaatatacacaagacattaaacataacccttgtatttccagtatgggtaaaagtctttggaggtgatgctggggtagaggcttatagattctattcatctttaaaacaaaacaaaacaacaacaacaacaaaaagaacggcttctctctttcaatttcccaatttccatttcattgagttcttcttgtctgttttgagatgcagcccaggctggcttcaaatatgtgccttagcctctcaatgtaccaccacacccaggtcaaagtgcattaaaaaaaaaatcctaaactggagagatgactcagcagttaaaagtacttgttgctctcttgcacaggaccagagttcaattcccagcacacacatagggtggaacataagttcctgtaactctagctccagaagatataacaccctcttcagccctccacggacacccacacacaggtacacatgcatgcagaggcacacccacatacataaataattgaaaaatggttgtaccaccaaattattgatgcatatgtaatctcagcacttgggatgaggcaagaatatcaagagttcaaggcaagcctccgctagctacatagcaagttcaaggcctgcccaaacaagatgaaacagtctcaactaccaccaccaccaccaccaaaatccttgccccaaagagcagcagacacactgatgtggggagtcctgggattccaactgtggcttggtttacaagtgggaaaacggagggagaagtgactttcccaaggtcacacagggactggtgattcttggacctcagacacagacagcagccaacagttcatctttactcccctgtccctcaactaaagggcatcccactgtcccatctcaggaaagtctttacctggctattgatgttattgttcttcctaaacaccaggaggcccccgatgaaggctgccaggaaagagtgcatctggtgggtctccccttgcacatgggactgtagggcacagagactcttatagatgaacacaaagcaagccaggttccgagagtgggtgtacgtggctttcaggatggcctgtagcttctcttggagactgcacaaacagaaagccccatgagtgcaggcccagagtacatatagctctgaattaggcaaggagctgtagcccatccaattcaaaacctctgtggagggtgccccatgtcctcaggggcactgcgctctcaccagactggggccttcactcagtgtcaccacctcagggatcactccctgacaccttgcattaataagtgcccatccccttcctcatttgtcttttccatcatggctctcatggccatttaacatttgtgagctgatttatcaagttcccttgtcctcagtataagttcctgcagagcagggtctagattttgcttgttcaccctaagggcacagaatggggcctgacacacagtaggtgctcaacaaatgggagaggtgagtgaacagtgaacagatgaatgtgtgcctgctatgagctggagttgcagataaaatcttgagaaatggcaggtctgctttctacatttgtggggcttatgggcgagggaataattgccaaggcaagaatcagacattgactttgattaagaggtggtcctggaatctgaaggattccaagcagaagactcatcatccaaaaggccccaaggacaggcacagaaatggagccaagcaatggagagaggtcactgcgggctctgagcagggactgtgtgtggagggcagtgaggaggtcagcacccagggctggtctttcttttgagatgaaaaggagctgattcaattcaccttttccttaaagggagagagagagagagagagagagagagagagagagagagagagagagagagaaagagaaagagagagagagagagtctatgtctgtgggtacccacagaggccaaaagagggcattggattccctggaactggagttataggcagttgtgaactgtgtgctgggaactgaactctagtcctctgtaagagcaacaagcactctcaatagttgagccatctctatagttccactaggggacaacaaagataactcagggagagagcagagtatacctctcaattctgttactggctgatggacttcgaagacagttaactttttttttttttaagatttatttattcatttatcatgtatacagcattctgtctgcatatatgcctgcaggccagaagagggcaccagatttcattacagatggttgtgagccaccatatggttgctgggaattgaactcaggacctctggaagaacagtcagtgctgttaacctctgagccatctctccagcccctcctgctatttttaatgttgattttttgctgcctcctgctagaagataaaccctaggagggcagggatccttgtctgtcttgtccactgctgtatcattagcagccacaacagtgtgtattatataatagatgttcactgaacacttggagactgaatgagtaagtttgggttttaaagaatgcttttggaccctgtctcaaaaataaaacaaaacaaaaatatttggaagggctgggcatatagctcagtgccagtgtgcttgcctactgtgttccaggctcagggccagtgtgcttgccttccaatgtttctcactctggaaagagaaagaaaggggagaagagaaggagagagaagggaaaggaaaaaaaatacaatttggagggcaaaaatccccaacatatataaacaaaataaaactgccaaaacagaaatcttttttaaaaactcaatctcagaagatggacaaaacagaaatcttgcaatttggacttggcctaccctctttgtattcttcttcttcttcttcttcttcttcttcttcttcttcttcttcttcttcttcttcttcttcgatttacttatttatattttatgcatataagtgctttgcctgaatgtttgtgcatcacctatgtgcctagtgtctgcaaaggtcagaagagagtgttggagttcttgggactggagttacaaatgattgggagctaccatgtgagtgctgggaactgaactcgggtcctctgaaaaagcagcaagtgctcttaaccaatgaagtcatctctccaatctctgtatacaactctcataaactacaggtgtgtctataaacatcagactgcaaggtgtttaaggccttgaaggaagggactcaggtcaggacacagagcaggagaggagagatcagagactgatttccagagactatgacccagaggactggacaggtttctgggaggaaaacagaagctggctagaagaggatagctccctggaagcgggtgtgcacaggccaatgagtgggagtgaagtatcacagcctgcatggaacagggcctgtgtgccacggaagcccacactggacactgtaggggttagctgtgtcacaccgcagagggttaggtctttgtggagcatagtgaggagccacaggcatttccatatggtcagagctggactttaggaagcacagggaatcgggaagccagtcctagcttggaaactactacacccatcctggcctgagggctgaccacattgtctcccaattggtatgcagagagggtaggtacctgccactcctgaagagaaaggtcatgaccaatgcatgaggtgcccggattttgactccatagctgtagaaacagagacaaacagttactaatccatcactgtagcagtttccaggaccctgcccccctttggcccctggtcctttctcccttccccagttctgataccatgatgggagaaaaataatgttggctttccagttacatctgggctcaagttcctgaggcccctggtagagtgacctttgccttagcttgaccctctctgagcttcagtttccccaaaaaggaatgcaaaaccccagagggctgggtaaatggttcttgtggacaaaaatgaagtatgcaaaaggtgtccactattcctaccttgcagaaatgctctctccactccttcctgacctgtctattatagttaggctcatctttgattaattttaaatttgatttattattactagtactgttttgttttcttttaatttttctgatgggcatggaaatcaggattcactagactctgtatagtggagtttattaggggaaaagaacgtagacagaaaacaagaggccctccagctctaggaatgcaggtcctgccaccccgctgctctccatcactgaaatgggcaagagagctccaagccccaaacctaatcctaatcactgatcgcatccatccccacctgtgaccacgcccaaaaggcgtggtcagtgctacaggcttgcactgcagttttcattacattcattcatagacaaagaatcttactgtgtagtactagctctggctggaactcactatgtacaccaggctggccttaagcatgtcctaacactcgggaggcagaggcaggtggatctctctgagtccaaggcctgtctggtctacaagtgagttccaggacagccagggctacttagtggggccctgtctctaaaaatgaatcaacaacaacaacaaactcacagagctctgcctgcctatatacccctgagtgctggaggagtgtgtcaccacaccaagaattttcattttatttaactttattgttgctattgttttggtggatttaaaaagttattgaagtaatttatttgtgtatgtgtgggggcatgtgggctagctagttttatgtcagcctgacacaagtgatagtcagctgagaggatggaactttaattgagaaaatgcctccataagagcaggtgtcaagtcaggcgttggtggcgcacgcctttaatcccagcactgggaaggtagaagcaggtggatctctgtgagttcaagaccagcctggtctacaagagctagttccaggactggctccaaagctacatgggaaaccctgtctcgaaaaacagcaaaaacaaacaaccaaacaaaaaaagaaaccagacttcaagttggttctgaaggcagtagtgaatgcctttaatcccagcgatcaggaggaagacacaggtggatttctgtgagtttgaggccagcctggtctacagaaggagctccaggacagccagggctacacagagaagccgtcttgaaaaatcaaaacaaatagaaaacagatcaggctgcaggtaggcaagcctgtggggaattctatttatttatttatttatttagacagggtttctctgtgtagctttggagcctatcctggcactctctctgtagaccaggctggcttcgaactcacagagatccgcctacctctgcctcccgagtgatgggattaaaggcatgtgccaccaaggccctgtgaattttcttaattagtgattgttttgggaggaacctagcccattgtgggtgggtggtgttacctgtgggctagtggtcttggaatccataagaaagactgagatcagctcctgcctccaggctcctgcctccaggtacctgcccagtctgagttctgccttggtttccctccatggactgtgacttgagatacgcaggctacataaacccttccctctctaagttgcttttgataatagcgtttcatcacagcattagtaacgttgactaggacagcatgcatgccacagcatgtatgtgtgttagagaacagctggtagcaatcagttttctccttcccccacttgaacttggggatcacagtctctctggtcttcttcaggcttggtggtaaatgctgttacctgctgagcttcaccaccaaccctggctttttttttttttttttttttttttttttttttggtaaggatcttgtgtaggcaagtctctatagctgactgagtgactgaggccttgaactcctgatcttcctcccaccacctcttgaatgctgagattgtaggtgcctgctaccttacctactttaatatatcattattatttcatgtgtgtgtgtgtgcctgcacacatgcatgcatatgcatacatggtacctttggaatctagaagaggtggcaaatcccctagagctggagttacaggtggctgtgacctaactgctgtgagtcttgggaaccaaactcaagtcctcttcaagagcaacaagtgttctgtctctgcctcccaaatgctgggattaaaggtgtgtgccaccaccgacctgcctttcttatttttctttatcagacatcttatgctggttagttttatgtcacaggctagagccatctgagaggagggagcctcaacttagaaaatgtctctataagttcaggctacagggaggcctatagggcattttcttcattagtgatttataggggagggccaaggtcattgtgtgtcataccacctctgggctgatggtcattgattctataagaaagcagactgagtgagccacgatgaacaagccagtaagcagccctcctccatggcttctgaatcagctcctgcctccaggttcctgcctggtttgagttattgccttggcttccctcaacaaactatgacacagaatttgtaagtcaaataaaccctttcctttccaagttgcttttggtcatgttatttcatcatagcaatagtaaccctaactaagataccttcaccttcatttctgcagctgtgtcaaggcttttgaagcctaaaatctcttgaaggccttgagacaatgtttatgagccaattttgactgtcacttgaatatataggaatattcactgcaggtttcaaaaaagaggggctcccatggcacacaccattagtctggtacttatatgaaacaacaaatggccagaatcaggcactgggtagacagctcagaaagtaaagttgcacagtaagcatgaggacccacggaagagccagtacagtggggcacattaacaaccccagaccgttgggacagagatgggcaggcagagccttgcagttcaccagtcagccagcctagccaatggatgagttctaggctcagtgagagacactgtcacaaaaaccaatacaaaaaatgacagaggctgggtgaatggtggcacacacctttaatctcccagcactcgggaggcagaggcaggccgatctctgtgagtctgaggtcagcctggtctacaagagctagttccaggacagctaggctacacagagaaatcctgtcctcaaaacaaacaaacaagcaagcaaacaaacaaacaaaaagtgatggaggaagacaattaatgtcaccctctggcctccatacgctcacccatgcacatatctgcacgaacatgtacatgagagagagacagagacagagagagacagaggatggtctcctctctctgttttcattttacaacagagaaattgaggcccaaagagagtaaaagagggcactgagctgagtgtggtggctcacacctttagtcccagcacttggaagcataggcaggcagatctgtgtgagttcaaggccagcctggtctacacaaggagttccaggtcagccagggctacatagagagactctgtctcaaaaacaaaacaaaacagaaaactaatttgggactggagagatgggtcagtgtttaggagcatcatatcctctctggcttccatgggtactaagcatgtacatagcacttaaacatacatgtaggcaaagcattcacacacataaaataaatgtatcttgccaggtgtacacacatttaatcccagcactcaggaggcagaggcaaatggatctccttgttcaaggatagcctgtcttcagagcaagttccagaacagccaaagctacacagagaaatcctgtctcagaaaaacatcaataaataaataaataaataaataaatatgtcttaaaagtaattaattaaaacaactttttactcttctttcctacagtacatcctgagtgaagcctccccctctttacccctctcactgcctctcccccagatccactgctcctccactcattaaaaaaattgggggagagggggtcatgatgagggacatccttctgtgtatatgtttgtcttattgattaataaataaagtactgttggccaataggaaagcaagataggtgggactaggagttgaggaggattctgggaaatgtagtaaagtcttgtgatccaggcaggaagtgacatagcaggcagactcagaaaataagcaggaacaagcaggaagtcgccctcttcctcctgctctctgctcaggagctcccatgtgaccactaggaagacaggacccaaggccagtggcatcatctataagtcttataaatatatagattaatatagataaaaatatcatagtaataatgataattaagactgagctagcagatagaaatcctagttattggccagcagcattgtaattaatataggtctctgtgtgttattggggccctaacatgccggcggaactcaggcggctggcagtaagacttattgttacagggtcaagacagggtttctctgtgtatctctagctgtactggaacttgctctatagaccaggttggcttcaaactcacagagatccctctgcccctggagtgcttggattaaagtcatacgccaccatgcctggcttaatttaaaagaatttttaaagagaaaatggaggtcagaatagatgaagagtcattcaatattcagaataagaacattaggattggagtcagaggacatgaccacagaaagtgccatggttgggagggttcacagaggatacagggagagctggaatcagaaaggattacaaagtcctcactgggaaatgcctgctggctctggagctaagtctgtgggatataaaagaacaaggtgggaaagtgggagcagagaagcaaaaagtgtaaggtctaacattattccaaaagaaaaacattaaaggtgtgggggggatgagatgcctttgtctgtatgtgcacacagccctctctctggaagacaacaagagagtcatcccaggactatctccatggagagggactggtgactgaggacattatgtaactattttagagtccgggatggacctcaggtcctcttgcatgctaagcatgtgctaagcacgtgctcttccatggagttacatgcctggttcagcagtgaacttttataacttttgtgaatgtgttacctaacttttaaaaaaggaaattaaagatgattaaaataactaacaacttgcctggcgttggtggcgcacgcctttaatcccagcactcgggaggcagaagtagttggatctctgtgagttcgagaccagcctggtctacaagagctagttccaggtcagcctgcaaagccacagagaaaccctgtctcaaaaaaacaacaacaaaaaaccccctaacatcttaaactgtgtttttgttgcagaagccagtctgctgctgtccttatcatctcctctgcctggcagtgtcaggcagttcccatcctcgtgcctgtggcccttcttccccagtatctctagaaccttatctccttcttctgcatagagagaccttcagcctcctccagttagccagggacttcctttagcctagacacaagcagactgtcttcaagtccctacatctgccaggccctttctcagagtcctcaagttcagataagacctgttacatcacacctgtaatctcagaatttgggtagcttagacaggaggaccttgagtttgagtacaacctaagatagacagtgagaccccctttttattaaaatgggggctagaaagatatcttggtcagtaaagagcttgccttgtaagtgtgatgacctgaatttggatctctggaacccatgtaaaaatcaaggcatggtgttgggcactatattccaaggcatgctgaggtagagggcagagcaggaagagtcttggagctggatggtcaagtagcctagcctacgtggtgaagttccagttcagagagaccctttctcaaacaaaaagtgaaaggagagtgcctaaggcatgatggcagggttgtcttggaccgccacatatgctggcatgcatgtgcacatatacatctgtgtgtgcacacacgcatgtaaaactcttgaacatttgggggtgagtcaaatgttcactaaggtcaaacatctcagtcatccacattgacctctctaaactaatgacctctcttcacaaatacagcaaatttttctccacctccaggcctttgctgaatacattttcatgcccagaatgccctggagaactccaacttggccttcagaatatcaccatcactccctctgaaaagaattcctgaatactactttgcattgatgtggtatttgggtttgttgttgttgttgttgttttggttgtagactcttgctattcagtccaggctagtctcagactcccaatccacttgcctctaaagtgctgtgattacaagtgtgtgttgccacgccaagccctgtcaccgtagtttgtgagacttccctttacacttatgatccttatagatgggcagagtgtcaatgccactaacaagtaatgatgtccatgccttggagattccggaatggctgagtttacagttttaattttacagaggaggaaactaagaccagaagagactacccagtttgtcacagtggaagcactaggattagagcccaaacacctgaccctaaaaatgtctgtcctggctggaaggatccagtgagaagggcacagagagaggtggggtagggggaggtgtacaaagcccatattgggcaacacttgctgtgtccaggccatacctggcaaaggggctactgatgtaacctcagggttcattctgtcctgatcaaaacatggctgatatgatctggccagatccagcaggaagcagtttctacctgacggagtgcccactctgagtctcaatcctgacggtaacctgacttgacatgtgcaggaacaatcagcatacctccccgagtcactaacgattcaactagaaggtagagagataagagtaattcctagttttcaaatattcattcaaaaaaaattgaatgcctataaatagagggattaccaggatacatagagggacaattatcggtaaaaatgtgtgttcctgtaaagcacattttgtcattgttgttgacagagggtctcacactatagcccaggatgacccagaatgcactatttagcacaagttggtcttaaactcacaataatcctcctgttccagtctcccatgtacaccaccccaggctgatttttactgagagacatggactatgaaataagattgttcagtgtctattgataacaagtgctacagagaaagaaacagggaggaaagttcagaggctgctcgtggggaggtctccgtgcaggattagtgaacctgtgacaacaaccatcacatgggcacacacaccagtattgtgctctgcatttcacacgactgaccagtcctcaaatagtaccatgcaagtgctctggggaactcgtgatccagaaagtgaggctctgaaaggccaaatgatccactcaaggtagctgacattgggttttaaaccgtggcagttcacacactcaacaccgtgccacacactgctacctggatgccaaccgtagggactttggtttcttctctgagtcattgctagttctggcacagcaacccctcaataactgtgaaagcctgaggtttcaagaaggtggagctgccctccaggcacccatcgatcaaaatggccctaagacctcctctcctacctgtaggagtgagtgagatcaatctgtccagcaaatattagctgccttttcttacgtttactgtcactttccatgagtccccagtgaaaaacgagggctggggtgaagtcatattgatgagaaacaggatgtgaacctgttagcaacttaataggtagtaggtgaccacctgtttgctaaaggacagagtccagtttctttggtgcacacagagacaccgaagccaaatagggcaaagtgcacacggcaagatgaggtgaactggacccaaatgaggggccacaggtgctggcatattaggcaactatgtcaagagtgccagattgtaaagcacagaggacctagaagagggacatgggaagccccagctcaaggctgacaaggtgacaggaacccagaaccccacttccactacaccagcaggacaccggaatctaacctcagagctccttagagagtgcacagcgaggtgacaaggggcctcgaacttgcgaccccggctaggcccgtccctcaaccctgaccagactctgcggccccactcacacagccccgttccggaagcccttaagcagggccaacacagcgtggtagcggcgctttcgcagcagcgtgttgacagcctggagaagagcctgcagctgcggtggggaggccatggcatcggagaactcggtggaggaacccggctggacgcgtactgacagccctgggctccggctgcaaagcccactggcacagggagcaccgccccgtcgttgtatccataggctgagtctgccgtcactcattcagcagagccagtcacagagcacactggtctgcaaggggctgagccgctcgcactcttcggactagctgactgattggaagagaaaggagagtcggtaaccaatcaccgggactcggaagagctcacgcaggattcgcccaatcagaaggcagctttcccagggagaagtttggttcattgagaggcttaggaggagtttcttgccctccttggagttgaaatggatgacttcgggggagctgacgttggtcttacctcacacacactttcgatgcctagcagatgtcgcagctaacttctcaagagcataaatcacatgccactcttgttgtctggtgttttgagacagctttctcatgcaacccaggcgggccttgaactctgaccactccctgcccacttcccacgtgctggaattgcaagcctgtgccattttaactgctttctacttacttttaaaatacaaactctttctcgggcctcccaggaacagacgcacttagtgtttgctggccctagcctctcgtcccatatcctcccttttctccaacttggttggcttggtttcccttcctggagtagtccaagagcgcttaggacttgcacctgctatttctctgttaaaatttattgccccttgaactttctatggctgacttcctctcagtattcaggtgtcagctcaggtaccacctaatcagggaagccctgcaggatatcccacagacagtaagtagcactgctcacagccaacttattagctcaggtttttgttgttgttttgttttttgtttttgtttgtttttcaagacagggtttctctgtgtagccctggatgtccgtaaactcactttgtagagcaggctggcttcaaactcatagagatctgcctgcctctgccttcccagtgctgggattaaaggtgtgcaccactactgcccagcagacagcccaggctttctgttgttttgtttgctgttttcctctctagaattcttcacattttctaattgttattacatggactattactttcctggagccagaaagttgtttgtctagttttctactatgactccagtagccaatgtaagtttccaaaatcactaagatgttaaattatcactgctagacaattaatgagtgacatttacacataatgttactgtgtgtaaaggtattagataacacacattgaatggtggctgtatttgggaggttgttccctggacatgtgatatttacttgtgatattgactgggctagtatcagaggtcagtaaaagaagtcaactgtgttgaacctacctgttccatcaccaaaattggctctctctctctctctctctctctctctctctctctctccctctctctctctcctcttcccgtttattctgttagtcctctaaaaatagtttattagaaaacagaatctctaggctagggatgtaactcagttggtagagtgttgtctagcatgcaagaagcccccagcatggtctccaacatctcctcaactggctgtggtggcattcacctgtaatcccaggataaaggaggtgatacaagtatctcagaggttcaaggttacatacaatagcgagttcaaggccagcttgagatacataagatcctgtctcaaaaggatatggagaggctgccaagatggctcagtcagtaaaatggttgctgtctaagcaggaggacctgaattcaatcctcagaacccaaggaaaaagctgagtgtagtatgtgagcttgtaatccagtactgggaaagcaaagaccggcagatccctgaagctcactggccagccaacctagcttaatggttgggcctggggtcactgtgagcaaaccagtctcaaaaagacaaggtagacagcttctgagaaatgacatcagtgattgacatctggcctccatacccatatggatacacgtgaacccatgcacacgcgttcaaccccataaattcaaatgcacatacatatatacacaacgtatgtatacaaatagtgattgtgttgtagaaatgtcctctagtcctccacgggatgcccacatactcctgctgtcttccttaatgttgagaatggatgactttacttggtgaccaagtctccagtgattgccgagaagttccgtcacattttgctagtactcagcaccagcactgctgagcagcacggcttgacctttgccattactgatatgaagggtgtggagcaaagggtctgctcaaatggcatggaggtctgcagaactcatggatgaggcatgaaacctgtgatcacagccatgcagattccacaccagatcaagaccctgacttgaacacaagaaagataagcagaaaggaatctagccaggctctggccagtgtctacatatcaagttctgtcaagaccttggatacctaatgatgattgagacccgtgcaatactgaagtcacttccggcacatttatgtccaaggcccccacaccaagaccattggccgataaggtcacagtatgggtaaatcttcagccatatctgttaataaatagccaatatgcctacttatataatatattgttttgttttttttcgagacagggtttctctgtgtagctttgcacatcatgctggcctcgaactcacagagatccgcctgcctctgcctcccaagtgctgggactagcactcggcatgtgccaccaatgcctggcttatataatattcttacaaacacagaaatgctttaaagtgtgaggaatgtccagaccagttatgaagtgaaaactagaaactagacagttaacaagaggactcataagctggaacaccaaaaccacttatgacatgagagccttggcaaatattgaacctgtgaatttcaatttgacaactacactgggcaagagatataagagtgaaagtccagggcctgctccaagtgaagaggcttagagcagactcttcaagtcaagctgaagaaaaaggatttcacattccaagctaatgtgacacaaaactactgtataacccctgagccccaaggaaccccagagaatgctgctgcagagctaaacaccacagttcaaagaagaggaaaggggaattccctttaaagctctttcttggaaagtgtggctgataagtctttttgcatcctcgggagtagagcttggtatgtcaagaaatttcaagctatgccaattgtggtggcacacaccagcaatctcaatcctgtcaaagcagaggcagaaggatcatggagttgggtccagcctgcgctatcctgtgagatcctgtctcatccagcttattcttatttaaaaatgttttactgttgctaagtgtgtgtgtgtgtgtgtgtgtgtgtgtgtgtgtgtgtgtgtctgtctgtctgtctgtctgtctgtctgtgtctgtgtgtgtttgagtgtaggtaaccagggatgccacagtcatttgtgagctgcccagtgtgggtacttggtaccaaacttaggtccactgcaagagcatacgtgatatttatttatgagacagggtttctttgtgtagctttggagcctgtcctggaacttactctatggaccagtaagagctggggttaaaggagtgtgccaacaccaccctgagtgttcatgatcttaactgctgagcaattgcttttctccagtccctgaaaatcttttctttaatataaaaataaggaagacctctcaaactatgaacaattgatgtctccacaaccttgcagaaatcagattcaggagcggggagtcagctaggtgatagtgtttgtcttgctagtttttgatggcctgagttggaatccccagaacccaagtaaagagtgcttattgggaggaggggagggaatgggaactggaattggtatgtaaaatgagaaaagattgttttaaaataatttttttaaaaggagagcaaaaaaagagtgtttgtctagtggggtacagttgtatggctcacacccttaatcccagcactcaggaggaaagttatctggctagccaaggctcataatgaaaccttgtctcagaacaaacaaaacaatgacaacaaaataataataataaaaattaatctgaagaagagcacgtctgcttttagtttcacaggtcaccagagataattaggctcctaagagaacatgaaaaatcaacagataagcagagattatagttgcaattcaggcacaggctttcaagaaaaaaaaaaaagacacaaaatttaaagctagaaagtagctatagagaacttaaaagtattatttaaaaattatgtgcacttatatgtatccgtgtgcgggatgtgcatgtatgtgccagaagtgacccatgtccctggagctggaactacaagttttgtgaactttctgatgtgggtgctgggaactgaatttggatcctccgaaaaagcagtgtgtactcttaactactgagtcatttctccagcccccagaaatattttttttaatatagcaaattaggtgatcctagcacttgagaggtagaagctagagtcaggagttcaaggccatactcagcttcatagtgagtttgaagttgcctaggctacaagagaccttgtcacaatccccacccccaacccgtgtgtctgtctgtgtgtgtgtgagagagagagacagagagacagagagacagagagacagagaggacagagacagagggagagagagagacagacacacacacacatacacacacacacacacacacagagagagagagagagagagagagagagagagagagagagaatgtgtgtgtgtaatttggaagaacaaagctgctagaaatttcacctgtaactacatggagatcagtctgagttgtgacatatggcccagtgttgggagcagatatttggaaacaattctgtttggcaggtcttcctgtatattatcttttggtaaggcctttcttaggtagatgaataagtttctacctttccaagcctcctaatgtgctaaaggcaaaaatccattgccacaatgagagtatttattacctagtgacccattttcattttgcacaactctaagtcctcagggcacaccatttatttacctttgcccagaaaaaaaattgcactacatgtgctatctatagaatactaactgggtatcagtttcttgcatgcctttgtgtgtgtggtgctgggtgtcaagctaaggggttccctgccacagaactacatgcacagcccttgaatactttgttactagtcttgttcttatagaaagtctgcaaggtaagtgctatgaaattgtcagctaacttacaggaaacagaggaacacagaggccaagtcacttgcccaagatacaatagctgttgaaggctagaggagggatttaaatccaggccacccagcttgcctctgaagattgtgatcttagccatatattagtttgttagtactgccatgccaaagtaccacagaaatctattgtaacagaatcctggaaactggttgttaaagaccaaagtgttgttagtaggtttcatctctctggagatctatctcccttgtttttaaagaaagtacctttaaggagaattctcacgtggtcaccctttttaaaaactagattcctaggcagctgtagtatgtatctttaacctcagcactggggaggcagagaggcaggtggatctctgagtctgagttccacctataaccagagctatagaatgagattctgtagctaattctgtctctaaaaaaattcttaaaaaaataaaaacatttatatatttatatgagtggagcatgtatgtgtgccactgaatgccactggaagttccagaacaacttttaggagtcagttctctgtaagcatgagttttctgtctcgggtctagtgaaataattacatccttgccttcagttctctcttccaccacctaggtccaggggatcaaactccagtcctgaagcttagtgggggacacctttactcactgagctttgtgcgtgcgtgcgtgcgtgcgtgcgtgcgtatgtgtgtgtgtgtgtgtgtgtacatgtatatatacatacacatacacccaggtcctcttaatcactgatccatctctttagctcccattttcttcatctgattacattgtaatttcatttacttccttagtgcatatatgaacacttgcaccacaatcacgtatggatttgagaagatagctggcaggaatcagctctctcctttcagggcaagtgtcttcttcccgtgctgagccatcttgtcagcctcccgcatccccgcccccaccccacccccagttctcaaggtgctctcaaactgactctatagctgagaatgacttgaagttgcagttttcctgcctctacctccctagtgctgggattataggcaagctaccatgcccatttatacggtgctgaggatccacttggagcttcctgcttgctaagaaagcaccaatcaaactataaccccagtccccacatacagaagaaacatactggactgggcctagaaactcctaggatgggggcgggtggtgaaagagaatacaccattctgtctgtaacaactgccaggccttgtttcctcctacgaacaccaaaacgtaaggatgcaacattgcttgacacacattcattttctcccctcaacctaggacccagatgtaagttttgtcattctgggggtaactgaagtgctcactgtgaagctggtcattaaaagtttctcagtcttttccttttccctagttggcccaatgcctggaattactacattagttgcttcagaggttcagtgccaactaggtagccccgagggagtaggacatgggactgctagagattgtgatggaggaagggatggtgggaaagaacggaaggtctgtagaggaagcagtctgactgggggaacccatcagtgttagggctttgcatccccgaaggctcatggacctgttccacccagcaggccatcggtcaagcacttcttggtagcctctgtgccaagccttgaggtccaaccagaatggatgcagtacttccctgattggtgtttggaaaaaagagctaactgccaatagcaagaaatgattacctggcggggatagtgccagctactgtgaccgcaacaaagggttctgttctaccctgggaggccacagacaatctctcaggggagcaagcaggcaggttcctaagttccatggaggacaggaaaactgccctttaggaagatgggacagcaagcagcacaggtgtgcacgtgccctgtgtggagagaaggagctggagagctgccatggctgtgctgccttgtgtttgtggagctttcactgtctgtcactctcagaacaaacctaaagtctcacatagtctcagctgcacttttacaattcttggtcctgagtgtgtcgggctagaaaagggtggggctgcacaaagagccttgcgaatgctaagcaggttagctgcccttggcctttaatttggacctcagagcctttgtatttgccattctctccagtttcccttttatcctttcaaaaagctgactccattgcctttcttgggtcatccacctcctcagagaggctcttcctgacccaccctgaataacatagcttctcttcataccagaataaagaatgatctgaagtcatagcctctctctctcctcattcccttatttacttccttgtctacaaccatctctcctgctggattataactgcacgaagacaacttttttttgtctttttttttgagggggtgggggcttgtccaggtttctaaaatctagaacaagtcctggcatacagtagctgcttagcaaacaaggtaaattaaatgaccagttatattaaaagggtaatagtgataaaaagctatgctgaacaaccctttaaggagagatcagaacctgaggccaatgggttaatgaatatgttaaagataggaaagaaggaattctggtcttactcatgcaaagggtattgggaaggaggctttagggctctggatctccaagagtcccaggaaaaggattggcctgtggagtctctgaggagtgtttttgtggtggtggtagctgtaatgataaataaaaaagaaaggcaaagtgggtacctttcggtgggccctgccaaggtatgccactaaggaaacatgtccctcaaaacagaggtagagcaagaggtttattggtggggggcgtgaaagactgataggctatgttagagtagggacaagaagtggcaagagaagaaagaggaaacagagagaggaaagaggaggcggagagaggaaagaggaaacagagagtggagagagggggcagagagaggaaagaggaaacagagagtggagagaggggacagagagaggaaagaggggacagagagaagaaagaggaaacagagagtggagagggggcagagagaggaaagaggaaacagagagaggagagaggggacagagagaggaaagaggggacagagagaagaaagaggaaacagagagtggagagggggcagagagaggaaagaggaaacagagagaggagagaggggacagagagaggaaagaggggacagagagaagaaagaggaaacagagagtggagagggggcagagagaggaaagaggaaacagagagaggagagaggggacagagagaggaaagaggggacagagagaagaaagaggaaacagagagtggagagggggcagagagaggaaagaggaaacagagagaggagagaggggacagagagaggaaagaggggacagagagaagaaagaggaaacagagagtggagagggggcagagagaggaaagaggaaacagagagaggagagaggggacagagagaggaaagaggggacagagaaaggaaagaggggacagagaaaggaaagagggggcagagagaggaaagaggaagcagcgagaggagagagggggcagagagaggagagagggggcagagagaggagagagggggtagatagaggagagagggggcagagagaggagagagggggcagagagaggaaagaggcaagagaaacaagacacagagaggtaagagaagaaagtggcaagagggcgctgtccctcaagagcacttttaagggtgcacattgttcagctgggacctccagctcccttctgccccatccttgcctctccaaaccctgtcctcttggaaaaactgccaaaaagttccgcattcctgcggttatggcagctcctcccctgaagcccccagctgcccaagaccccacccaggcaccatgcttgggcattaacccagcttgtggcagacacatcatcaccccttgactacagggcacataaacgcctggctttagtttggccatgtgattttttttttcctgccccttcccctttcccaatctctggggactggaggagtcactctcaagttgcttcaccaaaataaacctggtctttttcctttttaattctgcttgatctggcatactgagctggcggagaaacctataatcaggatataggaagcctattacacatgccccatagatggcggtggaaaggcacctggtgacaggtgatgagataactgcttggtggcagaggcaggctgctgttgcggcagaaactaacattcctcccttttgttgcttataaaaaggtgaggaactgggaagggttagcagtggggcaggaatgagaagatcgtgttcttgagactgcttcctgttgcctgggggtgttagcatcttgcttagtggcataccttggcagggcccactgaaaggtatccactttgcctttcttctttatttatcattacgttggtgtcgagactcacatacgctctcctggcatttggtctggtcaggctgggatcatacacctccacccccacccccgctccacctacaacaaatctgctttctagtttaccgctggctctgccttccattcaatactggcaattggatctctggccaggctttccacctcagaccattcccctggatgtgaggctttgtttctcgagcactatcctcgccttctgacttttcctgaagtcctggttaccaggtggctgtgttgcactcggtctcttagcccttgggccctgttcttgtatgatgactgctctgtttggtcttcctctgagtccagggatgcccgaggctctcaggtttgggacttctctctgcctcatccttggggcatcctgtatcatatacctcactcatcgcgcccattacgatgtcttttggagaccctcttaccactcttttcaaatcaaatctagtctcactataccttggaccaggtggtcagagaatggagaaagaattcttcactctctttctttgctccaagacctactcgttgctgtctgctctcctctaaattctgtaaacgtcctgtctgtatgtttgttgcaacgtgggagtcagagatggaaaggccggcttcttcttgctcagcacatgccagttctcctttgcagtgtctgctgacctaaccctcagtaagacagacatgccagctccaagcagctctcttatctcctccaaagaagatatttgggcacagaagcttgatttaaatatggcaacgctgaccactgggcaaaaaacaaacaaacaaaaaaaaccccaaaacctgccttttacttcaactgctgccaagaccctgtccatattgtggacaagcagaccaggacattgggaaatcaattgcccccctttgcctagacaaggtaggctgcttgaccccaagttcctaatccacaggaaagtctgtcagatattctgggcctggtagccgaagactgatgctgccctgagactcttcccccaatgaccacattggaacctggggtaggtgtctaggtcaccagtaagtctctctcattttaaaaatatttatttacttagtatgtatacagcattctgcctatacaccaggagatggcaccaggtctcattatagacggttgtgagctaccatgtggttgctgtgaattgaactcaggacgtctggaagagcagccagtgctcttaactgctgagctattgctccagtccctgtctctgttatttttaatagattcagaagctgcttggtctgcacttctgcttacttgggtgaaatttatccttctcagaactctaacagtatttgatgaccaggctaatgatagctttgtcagtttaactacagcaatcatggattcagctggcttctcaattctctttgtgtgcaaaattcaggccacaggcctcactttcctagagctactattaggtctagacacagtttaccttgttaccaggctctgaaaagagataaactcacaaaaatagatttcaatgtttttactattcctttggttttactattcctttatttaataaaactcactctacaatgactgctctcagtaatcaaccacctgtttcccctggtaaatgcttagatagaaaaaaagtgtaaagtttatgtgaagatacgaaggcttaagttgtaaggatctaagaaaacgatttagggcctaaggtgttttaagatgtataaatccgaattataaaggtctgaggagacagggtttctctgtgtagctttggagcctatcctggcactcgctctggagaccaggctggcctcgaactcacagagatccacctgcctctgcctctcaagtgctggtattaaaggcgtgtgccaccaatgcctgcaaggtctgaggatgtaaatgcttaaatggtgatttttttttttttagaaaaggtgacttaagatgtatggaaggatgaaacgtgttaggcttctttctgtggctttctactgttatattaagactccagaagtttatagtcttaacattaatcaatggatttcagataagctgctcctctagctctggtgaagcaccactactatatcatagtcacaaacccaagattttaagtcctctttggttgttttctaagtatagatttaaaagtgcttctcatttgctaaaaacttctgtgtaatctatatatacccagtcttctggatagagtaaagagtaggaatgcttttaaccagaatcatttttgggtcccctatgaatcaaaggcgtgagtctgccttttctacaatgtggacttcagtatagattacaaacaatggaaatgctaatgtttctaaaactaatctctttttgtaaactcaaaaaaaaaaaatcctgtaagctccagggagtcaaagtagatccacctggaacaggcgaaatgaactccaggtaagtactgtcaatcaacagcttaaatttccccacctactgcttgttcctgagggtgggatctcccccacttttccctgatcttgggattcccctccctcaatcatcaggacctaagaaaaaaaatccccctggaactttgtagctttatcttctgctctgccagcgtcctgccaggtccaggtgtcccctcaaaacctgcatcccgggacagcttcgaagtgcctagcgccaagtggtctaacctcacagactgcttcaactaggcctgcactttcctaactcctagcgctggagatgatcccacaaagcctggacaatgagcaaaacagccagctttctcaggtcccccaaagatgctttgcccccagacaacaggaagcagtccttatccctgcctcacttgctaactcttcctagttcctgatctttttataatacacaatagggaggaatgttagtttctgcaaggcagcagcctgcctctgctgccaaagcagttacatcatcacctgtcaccatcagctattcaacatgtgcaccccttaaaagtaccctccagggacagctcactcgcttgcctcttactcctctctctgctcccccattcctttctgcccccccctttcttctcatgcctcttcttgtccccactctgacatggcctttcagtctttcacccaagtccttcccgaaataaccctcttgcacagactctgttgcttgcagcatgcttgcttagtggcagaccttggcagggcctgttgaaagtgacctacttcaccttcctttttatttatcggtacagtagtgatggctttttgttgttgttgttctgtttggagacagggtctcactacgtagtcctgacatgcatagaactttctctgtagtgtcccaaaagagaggagctttaggtgcatttcttaattttaggagtttagtgaagagagtgaaaattgtggtttgtattgattgttcctttggctgaggcttaactgtgggaagcaaggaggatatttggagtcaaattcatggtagttcagtcttagaacaacatggctatgatcatagagaccatccattgttgatggcatctctctgtttcttctttccctgtgtgggcttcctccaacattcccttgttgtccaagggcaacagattgacatccctactgcacattgtagttaaatatttttttaagattttatttattatgtatacaacattctgcttccatgtatatctgcacaccagaagagggcaccagacctcatgaaagatggttgtgagctaccatgtggttgctgggaattgaaagcaggacctctggaagagcagtcggtgctcttaacctctgagccatctctccagcccttgtagttaaatatttttaatttttaatgatttattttcatttatgtgcattgttattttactgcatgtatgtctgtgtgagggtttcagaccctggaactggagctacagcaagtggtgagcttccatgtgtgtgctgggaattgaactcagggtcctttggaagagcacccaatgctcttaatcactgagccatctctccagccccatagttaaatatttttaaagattgaatgtctataatatcaaactaccctctaaattcctaactttctacccataggttaacgcatctctcagccatcatcagagaactctttgtgtaatggatggcagttaacccagaaactcacaactggttaaaatgtcagtagtgtgcccagccacaggtgggaaggacctctatctcctatctcttcccactaccaagactcatggatgaggggggtggaaagatattctaagagccagaggtcgggaaggactggggtgaaagagtgtctcagaaatgacaggcctatagcacttacaaactcagaccagctgcagttttgtctgcacaggatcaagctaatcagcattccagaacgcctgagggaggagctcactattcccattaagggctgccttgggagggatagtcagtttcttttaagggtgtagtccctggtagaccatgttgcagtggataacccaacaccaatcaatacactggcagacacattagactcggtggattataaggaaaacaagagaagccttagagatggctcagctggtaaaggtacttgctatagagcctgtgttcaattccagggtctcaaatagaaggagagaatcgattcctgaaggttgtcttctcatcttcacacatgtactgggtgtgtgtgtgtgtgtgtgtgtgtgtgtgtgtgtgtgtgtgcagacatttgccatgtgtgtgcgcacacacacaaataaataataaatgtaaaaagaggacatgaggggttggagagatggttcagtggttaaaagcattagctgctcttctagaggacctggattcaattcccagcacccacgtggcagctcactccaattccaggggatccaacaccctcatacagacaaatcaccaacgcacataaataaacaagaggacatgaaattggacgtgggagtgtgttatgataaagtgtgtggggagccttggcgaattccatggcagatgagggtgactggagggggggggggcgacaaacatgccaggcagacagagctttgtgagaggttttattagaaagggaaaaggggggaaggaaagacaaaagaggtagagacacagagacagagagaggacagaagagggagacaagaaaagtcctgctgccccaggggcagaaaaacaataagtggcgggggggggggggggtgtctttcttttaaaggggtcctttgctcctgagtgcagaccacaccaccatggaaccctgggctgtccagagtactgcgtgagtgcattctgccaggtgacaggagcaggccagcgtaatgactgaatccttacagggtggatccccacgaacttgggatagggatgactgagatgggtataaggtctgtgatggcaatggggtctcagagaatcagggtcgagggatgtgaataggagtggaggtcccctcaaagctggaaatcggggctaagaagagccttaagggaatctaagagataatgaaagattgacaccaggcagagatgaaaatcgttttgacaaggctgctttccaacttacgtggcacagttgcggggtgtggggtgtcattttacagttgggtaatgccggtgaggttggttggtgttgcaaagttggagaatactgtgtgcagcgataatgaatggggttcgtgtttcagaactagggccggtgtcggctttcggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccctgacccccgaggacttctgagacccactgtgtccctagagctgcggtgtggtcctactaaatgcagagcagggaaggagacgccgcctgtgcgcacagccgagtctgcagagaccacaggcccaaggcagtgaacacagggcaccggtctgtgctcccgagtcagaacccacgacgccgtgagcctgcacgggccacgccgctctctgatccgactggatcctgtcccgtgatgtgcaggctcaccgaggtggctgggcctcgggctctggagaaagcgagctctgagcgccaccctgtgcacccgctggagttgagcgagaaaggatagctctagagacaggagtggagctgggcacggaggtcgccgcgggggtgcagggtcgggtgagccgctggagtagacacttgtggacagggccggcagaaggaagcggagacttgcacttctctagatctcagccagttctcaccacggaatgatgaggggtgccttttgctatcgacgggtgtcgtttcagtgggtctcactgaaccagactccgcggttctcaccttccctcattattaccccatcccactcccgcctccaaaactgtgggaaagaatagtaaaagaaggtagctcctccagccaggtgtggtggtgcgtgcccgaaatctcagcgcttggaaggtgttagcttcggctacataatgagtttgaggccaacctgagcaccgtattcgcgcaattacattttttcttacagggtttctctgtggctttggaggctgacctggaactagctcttgtagaccaggctggtctcaaactcatagagatccacctgcctctgcctcccaaagtgctggagcaattacatttttttaaaggccatgaatatgaaggagagtggagaagttatataggagggaaatcgaagggaatatagtgatcaaattataatctcaaaaataataaattattgggggttggagagatggctcagaggttaagagcactggctgctcttccagaggtcctgagttcaatttcccagcaaccgcatggtggctcacaaccatctataacgagatctggtgccctcttctgctgtgcaggcacacattcaggcgaaacactggatacataataaataaatcttttaataatattaaaaataaatatcttccagaaaacaaaacagacaaaaccacaaaacaagaacccaaaaagaagatggcaaagacaccccaactgtgtgttctgtgaagaaaatagcagggatggctggaatctgggtagtggggttatgggtgttccctcttggagggcagtggggtattgcattgtttcagtgttcatgcgtttgtgtattggataatgagaaaagagagaaatcgggaagtgtagcttcactggccttggaaggtctccagcaccaaaataaataaaatttccgagtgagagaaggacagcaggtgtgcattgatccaatgggagggcaaaaggaccaggtggtggaagtggcatttgcaaagccctggggagagcaagatttcccgtatctcagttcagcatataacagctagagaaaagacctccactgatttgatgatgcttctgaactttatcttgggatcagtgtggtgctaagaaaaggttttcatcaaggcagccttatcatctgatgtatgttttataaagttcactctggcttctggggattggcctggagggggctgaatggcagcagggagggagtgaggagctaggttaggcaactgaggggaaggaaagagtggatttcaaatatatttgggagacagaataggttagatttgccagaagtctagaaatgtcaggaaggaagcagtggatgagatttggtggggtgcccctaggctcttggcttggaaggacagtgccctgctgttgtgcttgtagtgatgggtgttaccagaagagacagaagtggaggatagcctgtttaatttggggttgtattttttatccttttttatgtacatacatatgtcacagcatgcctgtggaggtcagaggacaacttgcaggagtcatttccctccttccactgtctaggtcctagaaatcaaactcaacttgccagatgcctctacccactgagccatctcacaggcccaagtattttatcttgaaaaacatttttttttcctcctgaaattctaagacaatatggagtggtcccaagaactgatttcccccagcttgtgcttttatgctgatattattttacactagtgactctcacctatcagtgtggaagaattccattgctatgagctgatcggtttcagggatccaagatcctagctggtcctttccaagccacattctgcatcccccccccccattctccctgcatccctgactactggcaagcacgaatctattcctcacctatgagatgtcgtctttgcaagactattatgtaagtggatcttgcctttgagacatatattttgttcatcaattacctcaaggtgcatctagctggtgtgtttgttggtatcctggaactctctttgtagaccagactggcctggaactcacagagatccacctgtctcttctggtattgaaggtgtgtacctccaccatctgccttaactggggtttctgtctgtcaggacagccactacttcccttcccagctgttgatggtcaactgatggaggcaaagtgcatctagttcccatttaaccacaaaagccttcatcaactcaaagagccccacccaccctgcataaagtccacttgccttcctgccaggatgccgctctgtgctctctgaggcagcccagcactttgtcccctagtaaaactgtcttcctaactatggagctcccccctcacagatactgacctgcactgtactgggacattgcagacaggatttctcacttgggaagtgaggtaacatcaaagggtattgatgctaaggttttggtaccaggtacatcctattccccaccctcttccctggactcctgccgtaaatttcctccccgggtttacaagggcatgagaacagagctcacttttgctacacgggcactgattctcttcacactggacaccgtgctatctgtctcagattctggtgcctgaagtctcctcagagcccctgccatcccattggccctctgtccatggtgttagtaattcttctcataaactacttagcttttatctctgtgtcctcttgaacctcctgactccatccaaaacctaacaatagaaaagggttggcagaagctgtgtggcagagcatgagccccaggcctgtacctcccaagatgtggaatgagaccactggggactggctagaaggtgcaatctaaacagaaggaatgcctcaaaatccagacagaaggaacacctcaaaacagctgcctttgggggtgggcagtagaagactggaaagaaggaccccagcaagtagaagagatccaagaagggtggctcctggagtagggggtggttcttggtgtctcaggcactgttgggtggcccttggtggaaggtgagagcttgagtgtcactagagggaatagagatgatggaagttggcaagaagatgtgggcacaggcagatattttgaagagtcaacatcggatatttgatgttggagggacagagatgaggagaaagaatgcaaggaaccttgtggggtgtgagtgaggaggaccagcgaacgggatttccaaagggctctgtgactggttagtctccagcaatggctttgagacattacaaaattgtagaaagtacaaaggacggtgatctaggggtgccacttggcccagaagaattctcgattttttttttttttttgatggatgggagtaggtcctggacctctgtacatactaaaaccttgtacatgccaagcatgtgttctgccatgaggcatgctctcagcttcttttcccagcttttttgtgttccagtccctagagttcatcctcacgatcaagggtggtgtgtagacttccatgtccttgttctgggaagcagagttggggattgggtaaagaagggcactacgtactagcagcttttaagacatcttaagatggctcagtaggtaaggctcttgccaccctaattatctgagttggatctctggaacccacataaagacagaaagagaactaatgtcacagagttgctctctgacctccacgtgtactgtggtacaaacaaatctcttggtttgaggatgcagctcaggtggttgaataacagctcacacccacacccacacctctcccccctcgcaccaaagccctgggtccattcaccaacaccacataaaactggttgtggagatgctcacctgtgatcccagcactgagagagtgaggcaggaggatcaccttgaactcaagagcaatttaacccttcataatgagttcaaagggggctggagaggtatctcagaggttaagggcactgactgctcttccggaggtcctgagttcaattcccagcaaccacatggtggctcacaaccatctgtaatgagatctggtgccttcttctggtgtgcagatatacatggaagcagaatgttataaatatgataaataaaatcttaaaaaaatgagttcaaaggccagcttggactattagagtgagaccctatctaaaaaaaaaaaaaaaaagaaaaaaaaaaaagtgggtaggtgatcctttgagaagctttcttttttgttcttttgttttctgaaacaatgtttctctgtgtcgcctggctgtcttggaactcactatgtagaccaggctggcctcgactaatagagatcacctgtgggtcgtgacctctttgggggtcaaatgaccctttcacatggagtcctaagacaattggaaaacagagatatttacattatgattcatagcagtagcaaaattgaagttaggaagaaacaacgaaaataattttatggttggggtcaccacaacatgacgaagtttatattaaagcgaagtttatattaaaacgtctcagcattaggaaggttgagaaccactgatttagccctagctgttctggtgctatatagaccatactggcctcaaactcacagagatccccctgcctctgccccctgagtgctggcattaaaggcgtgtactactacacctggttttgagaaactttcatgtaatgccttctgccccccttgatagcacgtagccctttcctagccgcaagagaggtctaggaagagaatcgttactctgaggccatgtttccagcttcacatcctggaatctgttgcagtgaagtagagagaacatattttgggtttttgtggtagatctggcttgtgagggtgaaggtgaagtggaagctgggcccacttcctcacaggctgcatttcctgtttcaggaatggacaatcagaccgttttggctgtccagtcattgttggatggccaaggggcagtccctgacccaacaggacagagtgtcagtccaccgcctgccatccagccactgggtgagtatctgccctgcccataagtagagggtaaatgtgaggttcatggggcacgggagagaactgcctttgtgctcccagactatcctctggtgtctgaattctctccctttctccttcatgcacctgcccatgcctttctctgccccctgcttagaggatgtggggagtggcatccatcttttgggagtgtccaagagccctgatgttttgcaacctttgccctggaagtcatgtttcagcttccattctgtaaaaagagatcaaaccaatttttccagtttatgggtcaagcctctgacacttagagaggggaaaggacttctctggaagtcctgtgagtctttattaatttatttgtaactaatttctttatttttttttaagaccaagattcataaagcctcaactggcctcaaacccgttatttaaacatgatggctttaaactcctaagtagctctctctggcctagaacttgatatgttgatgtggctgggcttgaaatcacacagatctgcctgcccctctcttcctaaggtgtaggttcttattcccgtagttcttagcttcaaaagctaagagaatactatgagagtccttaagacttgggccctagctgttgtatataagaatggaagtttctgctgggcgttggtggcgcatgcctttaatcccagcactccggaggcagaggcaggggatttctgtgagttcgagggcagcctggtctacagagcgagtgccaggataggctccaaagctacacagagaaaccctgtctagaaaaaacaaaacaaaacaaaacaaaaaaaaagaatggaagtttctgatgtcagcaagatggctccgtgcataaaagtgctggctgccaagtcagatgacctgagcttaatacctggaactcacatgctagagggagagaacccactcctgcaatagttctctaaactccatgtgcaagccatggcacaattatacacccactcactaaaatgttgaagaagaggaggaagaagcagcagccgccacctttaatccaagaagtggagacatgtaggatctctatgaattcaagtttgaggtctacatagtgagttcaggccagccagggctgcaagctaagatcttgactcaaacaagcaagcaagcaagcaagcaaacaaacaaacaaaaaacaaaacaacaacaacaaaaaagcagcaacaacaaaaagcctaatctaaaccaagaaagaaatggaagcttctactagcttcctcacaaatgaagctaatgtttctctccctgaagccctgactgcccatctgtagagctgctctgattttgcctacaccctgcagtccagatggacgttccctgttcccactctgattcccatcttttggccaacatgaagggggagaaaggaggatgaggaagtcataatccattccttttttattttgttttttttttggctttgtgattgggacttcatatgtagtgcaagctggtctagaactctagatcctcctgccttaacatcctgggtgctgagattataggtgtataccactatgaccagctacacttttctctttaagagaaatctgcatagatattacacttctgtcttaccccattggtcagaatatagtcatgtgatatgctgcctagcagcaaagcaatttgggaaaaatatacttaagtaggtaatcatgccagatattgtggtgatactcatggttggttggttggtttgttttgatttttgggtttttgagacagggttttgctgtagctttggagcctgttctggaactcacagagttccacctgcttctgccttccgagtgccgggattaaaggcatgtgtaccaacaccactggcatggcgatgctcatctttaatcccagcattctagaggcagaggcaggcagatctctgaattcgaggccagcctgctttacagagtgagttccaagatagtcaagatatacagaaaaatcctgtcttgaaaaaacaagttgtggggcagtggttgctcatacttttaatcccagcattcaggaggcagaggcaggtagatctctgtgagtttgaggccagcctggtctatagagtgagttccagaacatctaggactgttatacagagaaaccctgtttccaaaacaaaaacaaaaggaaaaaaatttaaaaagcatgaagtcatgtttcccactaaaatctgtactagtttataagaagaatacaatgaatattgatgcctggtttggggatatatcagtggtcttggtaactaataacacacacacacacacacacacacacacacatacacaaattgtgtaataattggacaggtgagctacagtgtgctttaagacagcataaatggctgctgttagctatctctactttaagtggcttttcatttattcagcacacaccctttgagggccttctaggtgcccaggttataccacagccactctgataaataaaacaagtttctttcccttagagaacacacaatctggtgctagtgagaaaatggtattgatggggccagcccagaatcaggaactgtggcccgagctgtaagaagattgcctgggtatgggttggggagatgattcccagttaagagtgtttgcacaggacctgaattctagtcccagcacacacataagatgactcacaactgcctactgtaaatccagttcctctgttgccctcttctggcctctgagggcactgcacttatgtgtgggtagacacacatacacacacacacacacacacacacacacacacacacacacacacacacttaaagcatacaaacaaatctttatgaagacttcctagaactgatgagccttgcagcatgagttgaactgagatggaccgggaccagggtatagtggatgcagaggtatgagaagtagctacatgacccactggagactgacagtcaattcagtcaagatagagtctgtatttctcaactttggagtgaagtcactgtactgcttccatatgccaaattatttgatgcctgtctgcacatggctggctcttcctgaaggttcctgttgggctctgaacgttcctaggaagcacatggttggtgctcaacacctgcatggcaaggcacacagtgttttcagacttgctgttcagatgccagctgtggtatcgcattcttcactgtgatcccccctgactcattcttgcttttttcattactccactccatgtgtggcccacccaactactggcctaaccctagatgacgaggatgtcttcctgtgtggaaagtgtaagaagcagttcaactcactgccagcctttatgacccacaagcgtgaacagtgccaggggaatgccccggccctggccaccgtctctctagctaccaacagcatctacacaccttcagcagcacccgctaccgtccagcaggccccgcctcctgccaaccgccaggtagccttttgttcctttgtttgttgattcctttagaaggtctctttctgcacacactgtcctaagtcttggaggaatggtgctgggcaggactgacgatgtatctacgttgtggtgttggatgagatgcacaaagatgggcatgttttgctgggcatggtggtatatacctgcaattctgacacccaggagtctgggccaggaggatcaagagtttgaggccaccctgggctgcagcttgccaggtggcagaaacgcgccttcctgagtctgcccacttttctaagtcattcagaaaagtatagattcttttcttcactaatcccttatctaagtatgcttttcacaacatacttagataaggggtttccttattcttgctctgatgcttcgtttccaccatgtggctgcttgtccgccgtgtgtctgatctctgtgctgactttagtggtatgttttgttttattcttctttcctccattttcttcttctaacaagttgctgatatttacagttcacctgtaaatgtgggccctgtaggctttttcttcctcttttcttcctcccgcttcttgatgttgttcttctttttggttttttgagttaggatttctctgtgtaaaaggtttggctgtcctggaactcaccttgaacttgcagagatctacctacctctgcttcccaagtgctgggataaaaggcatgtgccatcaactgcccagcaaatctctaaataaataaataaataaataatacttttcccggggctggagagatggctcagaggttaagagaactggtcgttcttccagaggacccaggttttattcccagcacccacatggcagctcacatctgtctgtacctccagttccagtggatcaaatgccttcacaccaatgcacataaaataaaattaaataaattatttaaaaaaaataatacttttcccagtctattaaatgctgagatggggtgggagattttaccatattatgtgtggtatttggagcagaactttgaagaagtgacatgtgaccagaggttcaagaggcgagggagtcagatatatatattgtgttcctgcaaaggctctgagattgaagtgtactgaggtgttccaagagctgcatccaggagatgacagggcggctgggcctgagtgagtaagggaggggtcagatcacgtgggccctgagtgagtaagggaggggtcagatcacgtgggccctgagtgagtaagggaggggtcagatcacgtgggccctgagtgagtaagggaggggtcagatcacgtgggccctgtaggcttttacttaattacaggcgccatggagagtgttgagaagagggacctagactgacctacacttgccctatgcagactgctctgagttcttgcttccctagaacagaaggcaggaattttattgctggaccaaaggtctgtgcctttcagagagatgtgacccctcctcattggtagatgactaattggagtctcagaaatgtagactggcttgccaagagtcaagtgatgggagcagctaggtggaaaggctccagaacctggatttttcattctgtggtccatgctttttctttttattttgtgtttttaggtttattcgttttattttatgtgtgagtgttttgcctgtgtgtatgtatgcttgatgcccttggagatcagaagagggcatcaggtcctgtagggagagactctgaatacttgtaccactgaccacgcccaaggtatggagaggggtaggataaagagcgaggaggagaggtgctcactctttcgaggttcaagccaggtctcggagtgcggagtgcgtagtacgtctgagactgggctgctcggagtgctaatctgattatcggctacacgtgtgagttgttttcatggttattatttataatatactattaataaccgtatcttgcatatcctttgggcatggtcagcagtacaggtatccagggtctctccctacaaggtcccttggaactggaattacagctggttatggaccaccatgtgggtgctgagaatcgaacttgggttctctgcaagagcagggagttcttttaaccactgagccatttttccagccccttgtttttgtttttaaacacagtcttcctatgtagtcccggctggtctaaaatttactgtgtaatatgttaacctcaaactctcagacattctctggcttcccaggtgctaggatttcaggtgtggaccctatgtgtggcttgaacttaggtctttcacatcactcttcagcttccttatagagcctcagacatgctcccccctctcttgctcatctagatctccacgtacatcacagtgcccccgtccccactgatccagaccctggtgcaggggaacatcttggtgagcgatgatgtgctcatgtctgccatgtcagcctttacatccctggaccagcctatgcctcaagggcccccacctgtgcaggtaaggtggtgggtgcttctcataggggtctttttttttttccttcttgcaatgctggggactgaccccagggccttatacatctctcaagagtttcattccaaatctgcaaattaacgcctatgaaatcagaatactgtagaagaaaattgctttagctccagctctcctacatggaagggactagctgcctactctggctagcccagctgagcaatggagccgtgacaaccacgtccagctattctgagtcctgtttttattcatggtccattagaaaatatagtggctccttggaattttccagtacacataggtgaccagccaccaagaccagatttcaggcttccagaagggaaggagctggtcccctggaccccccctatttgaacattctagtaagtggctgctatgtgatcagtatcctgggaaatgtcccaaagtcagtcttgagtcaccaatcaagagccagtcctgctttacaaactttttttctttttctcaatggccttgttagacctcctgggctgaatcatgtgtgcccaaggcaggctagcttagagaagagggagcgaagccccaggccgacatcccttgacattctcccaggtctttgctcctttccctgtcccagtactgttctctgagctgcccggtgagttcctgtcccttccacatgctgactaaagcctttcaagttgatgaaacagacacttcaatgctgtcattttctcttctgattgcagaacagcttgaacatgcatccagtgcccaactacctcacccagcctccaccgcctcctccgccccctccacccttacccccacctccccagcctccacctcctccgccccagaccctaggcccttctgggcgttccaaccctgttgggaacagtgtggtggaggtgtacagtgctgctgcacccatggcaggaaatggaacagtggagatccaggctctggggatgcagccctacccgcccctggaggtgagcagaggcagcgtgtggtggaactgggcacaatcgtgccagacactgtgctaaggccactgtgaagatcaaaagcagacccagccttctcatgagtgcctgcgtcagggagaggaggactttcaccaaagcgggcagtctacagatgggacacgcaaaccgtgttagggcccctgaggggcgtgtaacacagtctgggtttaaacccagacagctgagctacaaagttacttcatgaagtttgttctgtttctccctccctccacccccctctctttccctctctctatgtgtgtttgtatgtgagtgtgtgtgcatctctgtctgtctgtctgtctctcttctttcatttagtggatgggggcatatgtgtggaagtcagaggacaatttgtgagagttcagtctccttctaccccgtgggctctggggattgaactcaggtcatgaatctcggcatcaaagacctttacccactgagctatcctattggcccagttcatgaagttctaaggggtcttgggagatctgagtgagccaggtgcaagcttatgtgataatggaatgtcagtggttgaacacagctagggctacagtgagggtccattagggtccccttatcctgtcccttctaaggcttttcccctcacagtgctatccttctaggtgccaaaccagtgtgtggaggctccggtgtaccccacacccccagtgtacagccctggcaagcaggaattcaaaacaaaaggacccagctccactgccccaatgaccagtgcaactgggagcacagtggccacctttgactccccaccaacgctgaagaccagacgtgctaaaggtgccagtggactcccagaaggttggccacccaccctccctgggcatctttccttggcactggcctccccacaggctgcttgggtctagtctttgctgttaagatgagtagggttgtttggtggtgtgtactggaaaacgtaaactagcattgacttcagaatgatagggggtttctttccttagaccaggagcagaaactctggaatttctgcagtgccgtcgtcaaatagccatatcacttctgttcttccctttctctgtccctagagcatggcttcattttcagggtgccttgtcacctgaggtggttgctgaaatgccagtcatcaatttcatattctagaaaataagaaagtagaggaagagaagggtaaagggggactctcccagcttcctgaagtcctatatagtcaagactttcttcatatatagtcatgtggctacgctagctacaagggaagttaggaaatgtttgtcttagccaggagcaggaaggaggcaaaagtggctaccagttacaccagttgtggtcttcccccttttagagatgtgaggtgtggaatcagagtagaatcagaaccagggaatagatgtggggaaaggaactgggaatttttttttttttcaagacagggtctctctgtgtagccttggctgtcctggaacttgatggcctcaaactcacagagatcctgctcctctgcctcccagaatgctgggataaacggcatgtgccaccactgcgcagctcaactaggaatgttttaagagcttccctttcgaccccttcttttttccttcttcctacaaatacacattaacaccagtgcatcacctacttgggatttaggtcttggttcaggatctcctcctctgtcagtcactcacagtttaatgggagagatgggtaggaaataagtgggtatttatgagtttctccagggagatcacagggtagaaaaggacacagcttacctatctggacagaaggaggtggtcctgtagggactgaaaggcaagctttccaggcaagaggagcagcaggcataaagtcctgagctgagcccatgcttgggatcatcgagattagcaaggagtccattgcaggacagagggagctctcaagttggcagatacagaggacatggagaggtggtggatttcaccatgagcagagaaagcctctgagagagttttgtctgactttccctcttacactgtctacacataaatggagatgtcccagggcgcatgctgtctggccccaggtacaggggagaaatggttggaggtttcccctatctcctcagctgggcctgactatccctctccttgtctttcagctacagggaagcccaaagcccagaaactcaaatgctcctactgtgacaagtcatttaccaaaaactttgatcttcagcaacacatccgaaggtacaggcagccttgggggccgggctccagcacagcgccaactaggggccacctgcatggaagtgaggccccttcccaggctctgtgcccatcttcaggcctgcagtgcccaggaggagggttcctcacattcttctcaaatccaagggctgaacccgcccaccgagacagaaaggttggcatgtctgtttggatgggtacccttgaactgagagcggctttgcacacacacaaggctgcctgtcttccaactgcagaagggttagcctgcaggctgcccgctgtgccaggatagctaactacagagggtccttcctccccaagaatgtggagtccatctgtggaatggtggggtgggcagactccgcacctcttcacagtgggatacgttagtatgtaggggacttagggtcagtcatggctctggtgttgggaaatttggaatggtgtggtgagatgatttcaccttaagtccctaaagagtcaatggaggaagtctcagctttggactaatctgtcttcaacacctgttcatttctgagagagaatcaagggccagtccacacaagcacacgacatctatctagatcagggtctcccaacactgcattattgggactcgggcttggggtcaagtcgtgctgactgtgctttgtggaatattcaaaattatccttagcttctgaccatagatgctaccaccacctcttccacagctgtgacagccaaaaatgttttcaaacattgccaaatgttgctaggagcaaactggacctcatctggcatacatttggcaatactagaaatgtccaaattggaacagttaacctttcatggctgttaggacttggctagtgcagctgagaagactttttttttttttcccaatgcaaaagcaaagagtcttttattgtttaatgagctaaccacattagctcaggcccagctcgggccctttacccgtttatcgcagcaggtggctggagaaggacctaagaaacagacttttaaatttcacttgtaatgaagccaactgtgactggtcccacacggctggcgtctgccttaacacggttggtgtccaccttactgggtggtgctactttggatcttcaatgacattgtttttataatcactgaatttttccattacttctttttgtttgtttgtttgttttgtttttcgagacagggtttctctgtggctttggaggctgtcctggaactagctcttgtagaccccattactacattttcaatacatagggagtcataaaaaaatggtttttcatattcaataacaaccaatggggaacttctcaaaattattttcaaagctgggcatggtagcacctacctttaattccagcactctggaggcagaggcaggtagatctctgtgagtttgagggcagcctctctctctgtctctctctctgtctctctgtctctgtctctgtctctctctctgtctctctctctctctcgctctctctctcacacacacacacacacacacacactttgctagggttcttgtcctaccaggtcctgctgcttcagttccaaatgaacacagcaacactatattagttattaaactgttggccaatggctagggcttcttattgactagctctgtcttaattattaacccatttctatcaatctatgtattgccacaagactgtggcttacccagtaatgccccagtgtgttgttactccttcagcagcatggagactctgtggcgggctccctctgcctacctttcccagaattctccttgtctcctcgtcccacctatcttcctgcctcattggccaaacagtattttattcatcaaccaataagagaagcatatgtacagaaggacatcatacatcatacacacacatgcaagcacacgtgcacacacacagtttgcttcctacttgatgccttaaaagttaggaaatctgtgatctcagatgtgaggtggccaaggagaagggctgctgactgagcggctcaagaacaggtctttctacctctggtctatctgccacattgggagaacaagtcctagtggtgttgggatgatggccagcagcgtctcttggccttcctggtggctgtgatctcctgggtagaggccatgtccctgtttctatgaaggaatgacaaataactgtgttcccacagccacacaggggaaaagcctttccagtgcattgcatgtggccgggcctttgcccagaagtccaatgtcaagaagcacatgcagactcataaggtgtggcctccagggcgcagtggtggcaccatttctcgaaactctgtcacagtgcaggtcatggctttgaaccccagcaggcaagaggaggaggacacaggtgagtgaggtgggaggggcggctctccccactcatcccctctgaagtcccaaaggtgctgtctgtctgtctgtggtactggggaccaaacccagggtctctgcactgtccccagccccagtctcattggtgttgttgctagttgggtggcttccatgacttcgctggagttcagcctactttatctgtaaaatggaacctaaagagatgggtgtgatgtacatgaatcattcagctttggtgagcccaagacgggggaatcaaggcctgactgccacatagtgagtttgagtccagtctgtgctgtacagcaggctctctaaaaagggacatggggtgaaagcaaggatgcgagtatgtaagatatgtgacattagtctaatactgtgcccaggcagacgtggacatcactcactaattagtgattatctctttctggctgagcctggatccatatgagaatccaattctttcctcccttcctctccctgcaccccccaccccccaccccaggtctcatgtagcctgggctggcttggaacttcctatgaagctgagaatgaccttgaactcctgatcctactgcctctgcctcctgagtgctatggttacctcagacctgagctactttacccagtttatttgtttgttttggcttttttgtttttcaaggcaagttttcactgtgtagctctggctgtcctgtgactgtagaccaggctggcctcaaactcacagagatctgcctgcctctgcctcttgagtgctgggattaaaggtgtgcaccaccgccgcctggctattttacccagttctgtgtggtgccagatgttgaatgcagggcactgtttgttctgggccacaggtgggccctttctgtcaagctctgtcacttgccctcagaatccatttccagtgctccaggcagttcctgtagttgatcagcacttgaaacccttggatctcggtgggcagctgctcctcagatgtcctgcaggttctcattcatccaagtcttcaggggctcctgagccaacagtcctgtcccaaatgctggttagttctcccacaaaggagttagggacttaccaagttgataaacagaacagtcattggagattcaacatgaggaccataatgtaattgaagtttttttagtagtccagcatggttggtagttctagtgctccagaggctgaggtaggaagattgtgaatttgaagccagcctaagctatataacaagatcttgtctcagaaaaacaaagcaggaggctgtagagatggcttagcagtcaagagtacttgctgttcagtcatgaagaccagagttttgatgcccgcagatacaacaggtggcttacagatatctgtaactacggctgcaagggatctgatgccccttctggctctcaacggcacccactcatacagacacataggcacacataagtgagataaaaataaaatttgagatagacttcatatattttactgaacctgatgcattcttgcttcacaaagtagcataaaggacttttcctttgtggagctgggtgtggaacctggggtccttctgttcttctacagagccacaccctgtaaatggacttttctttgggctgccagcttacaaaaaaatgacacagaggcttcttattaattatgaaagcctggccttagcttaggcttattcctgattagttcttacaacttaaattaacccatatcctttaatctacattcttttacggttacctgtactctgtactgcccatcctgcttcctctgcgtctaactggtaattccaccttttttcctcccagagctctctctgtccagaagtcccgcctatgcctcctgcctagctgtggctgtttagttttaaaaaaaaaaaagattttatttatttattatgtatacaacattctgcttccatgtatatctgcacaccagaagagggcaccaggtctcataacggatggatgtgagccaccatgtggttgctgggaatttaactgaggacctctggaatagcagccagtgttcttaacctctgagccatctcttcagcccccatttagctttttattaaaccaatcacagtgatacatcttctcagagtgtaaaggaatgtcccataacatttcttccttttgtctaaataaaaaagaaagattttaactctaacacagtaaaactacatacagtaagaataattatcagcagggtagtggtggcacacacctttaatcccagcactcaggaggctgaagcaggtgggtctctgtgagttcgaggctcacttagtgcatggtactggaggctccagcctgcaagcagcagtggtagctgcacctctatgccgccaagcaccagcctgcctgagagactgcaggactaggaagccacatccagctccttgtgcagagcttttcttagctttctcaggctatatgtttagatatttgagccctgacattggatgccatttgtaaacagatttttctttgggtttccagctcacaaaaaaaaaaaaaatgacacagaggcttattaattatgaaagctcagccttagcttagacttattcctaattagttcttacaacttagattaacccatatcctttaatctacattcttttacatggctcggttacctgtactctgtactgcccatcctgcttcctctgcgtctgactggtgattccacctttcttcctcccagagctctctctgtccagaagtcccacctatgcctcctgcctagctcttggccgtttagctttttattaaaccaatcacagtgacacatcttcacagggtgtaaaggaatgtcccacaacacacaacaccccaaagccatatggaaatattgtgtatatttgtttactgaatttttggaatttacggcacacctgcactggcactggctatcttctagatcttgcatgtcacccatgactgtggccattgtgtaggacagtgtagagccagaaccacagttcttcctacccaagcagggtgagcagccccggccacatgccagctgctgaagagccttttgttgggctcgtgcccagggactgcttttatctgacacaccagtgctctgttggagccagccctcttttgcacctgggttcttgctgtctgaactcctgcccagcactggaggccactcattaagcatacattgtagagcctattgtgtgctggccatgggctacagaggtgaaggagcaggcccctgatgtcagggagagtgagggatggcctaattagcaaagaataacaaagcaaaggtaagtggtgtggttagaaaggcctgagaggcgatctgactatgcttgggaatgttcagtttctaacacccatggagaggtcacagtatctgagtgaagatagggagtgtaacagaggtcactagctgtctctcagtcagaatgtatttcagggcctgtggatgtacctcaggatagaggatttgccttcacacaggatgccctgggttcagtccccagcactacataaattcagcatgggccatgtggtggtggcgtacaactttaatccccacactcagggaggcagaggcaggaggtagatctctgtgagtttgaggccagcctggtttacagggtgagttccaggacagccaaggctacacagaaaaactctgtcttgaagaaacaaaaaataaaacaaacacaaacaaaaaaaacctcatggagctggagagatggctcagaggttaaaagcaccagctgctcttccagaggtcctgagttcaattcccagcaaccacatagtggctcacaaccatctgtaatgagaattggtgccctcttctggtgtgcagatatacatggaagcagaatgttgtatacataataaataaataaataaaatcttaaaaaacaaaaacaaaaaacctgagcatggtggcacagacttgtaatcctagcacttaggagatagtggaggaggatcaagagttcaaggtcaccctcagctacatagcatgtttgaggccagcttggactacataagaccctgtctgaaaataaaataaaaaagaatgtatgttagtgttttagcatcttgtgcatatgctaagtatagtcctaaatacagcatgtgatagcaagtctacagtaggtgtcccaggagccctcatgcatggagtggctcctgtcctgcctgactcaaaaccttcctctgactttcctctctctctctgacttttttctctttctgcataggattgggccaaaccctgtccagcaccacacagccccaggccttgcccacggcaggtgaggatgaaggtggcaagccagaggccaagcaggtagtcctcattgacagctcctacctgtgtcagttctgccccagcaagttcagcacctacttccagctcaagtcccacatgatccagcacaagaaggagcaggtgggtgggtgtgaaagcagagggcacagctgctcacttacaagcctcatggcaccggggtcaccagtgctgcctggagagggacaggaattgggccagcctttcccatggctctttgtcctgaagataggttcctggagggtcaatacacagttgggttatgaggtttgtcatctgacatagcaggaggctgagccagggcaagcactcagctcagattcaagggctttgtgtcttgtctcaccagctctagtggctgtgttcataaggtgtggccttgtctttcatcatggattccctcctgcttcttgggaaacctgctgactggaactggctatgtagagcataccagcctcaaatttgcagaggtctgcctgctactgcctcctgagtgctgggattaaaggtgtgcaccaccatgccctgtgctctatttctgacctttgttgtgtgtgtgtgtgtgtgtgtgtgtgtaagtgccgtggaacatatgaaggtcaaaggacaacttgtgggagttggttctctcctcttaccatgggagtcccagaaattgaagtttaggttgtcaggttcagtggcaagagttactgtcagggttactctttgtagaaaatccagtcatagtatttctcatgagcaatggaaacctttcctagaattctctaatcttttatggatcagagacagttttgttttgtttttgttttaatccgggctcatggggctagagcttcggctcagtggttaagagcaccgagttcatttctcagcacccacatcagatggttcacaacttccttttagtccagctccaggggatgacaccctctgctggcctctgagggcacctgtacttacgtgcgtgcactgatgatgaccttggagttctgtcctccaagcactgaaataggccttcatacatgctaggcaagcctgctaccaactgagctgaagactggccaacagttagggttttatttctctcctatcataacaggcctgaaattaacagtgttgggcttgtctaacaggctaggcatgtcatctaaggccaggcttctggcttcctcctctagtatccttagcttgtagtattcaccctcaatgctgcagaatagttgctgtgtctccatcacatttatctcccagtcaagataaatgcaaaaattagaagggattcctgctagcaggcttttgccattttgttttgggaggtatggtcgccccaaagatggctgcctgcatatcattgccaagaaagtaacaacatactagattcaaggctgccaggaggacccagtctgttgctaccctgggcaaattggagttgacttcattaggaataaagagggtttgacactgtgtaagcacctgaggaatattgatgactactggaattttcaaaatatcaaaagcatatttcttttagaaatgagaccagacatgtgtcagaatgtcacatagatcatgaaagaaacagtggaaatgatatgtgtgacacatacctcctgtgtttgactatctccacatcagactgccaaagtagacacagatttcattaatgtctcatctataacctttggagttaccccttctatctaacaacaacagtggccttgagttatatccgtagcatcacacataaatacacaaaaatcatttatactggattttttttttaacaaactaacattgaacttgagagtctgggtcctaagtcaatactacatagtcaaaattagtcatgtccccaaggagcaagaggaccctagggaagtttgtttggtagtaactccaacaatgatctccagacttgtcatctgagaattcctactaggtgtaagtaacatgtttgggtcacaaacttctgccaaatcagatactctggtggtgatgcctctcaagtcttcttcttcttcttcttcttcttcttcttcttcttcttcttcttcttcttcttcttcttcttcttcttcttcttcttcttcttcttctttgatatggagtctcatgtagctcaagctagctgtaaactcactatgttgctaaggatttttttttaattttaaaagatttctttattctattttaagtgtatgagtgttttgcctgtatgtgtatgtatatcatgtgtatgcctggtgccctggaggtcagaagaaggcattagatttcctgcatttggagttatggttatgaactaccatatgggtgctgggaattgaacctgggaccttgcaagagtgacaagtgctcctaaccgtcctaatggctgaggtattgttccagccccaccaatagtgatattgaactccttttcttttttccttctttttttttccccaaatgctgggattacaggtgtgcatcactgccatcagataatgatgggagccacattagaagggtatagtgtcatcccttcactgtacttccaggtcttgggtaatttttgtgtatacatttcggcttcaccaagccttagggaagaataactggtcaagagaagagaaccttgcaatcttagtggagccaggaactgagcctggtgccacacagcctgtgatcgtcaggagacttatgcacgagcatctcaattcaagacttgactaagctacagagtgagtttaaagccagactgggcgaacttagtgagcacctgtatcaaaataaaaagtaaaaagagagctagagataaaactcaatggtagcctgcttgcccagcatttgggaggccctgttttgtctgtagggagcaggagaacagctggcaggttgttcacagtagtgtgtatagcctcatgccagggccacagggtaggggtagccatcgaggtgattcccacgtctctcacctcccagtgtctcctcccaaggtgtacaagtgcgtggtcagaagctgtgcccagatgttccccaagctggacacctttctggagcacatcagaagccaccaggaggagctgagctaccgctgccatctctgtagcaaggacttcccctcattgtatgaccttggagtgcaccagtactcccacagtctcctgccgcagcacagccccaagaaggacagcaccgtctacaagtatgtgtgcatgccacctaccccgctggaccagtgggcagggagcctggcccaggctgctcaggatcagtaacaaattgcaaagggaaactgaggctaaaaactggggtccagcctagagtgtttgagtgttttggcacctgtgggaaaaaatgatactgactcttcttagaccattcttcacttctcaggtatttaccatggaaacagcaccttaaaaagggtaactaggggccagaaagacggctcagtgagtacaggtgcttgctaccaggcctcccggcctgggtgtgattccaaagacccagcatggtggagggaaagaactcacttccatttatttttctctcatctccactggcacacgcacacacaaaatagataaatacaaatgaaaaggaaaacacacacacacacgttagctgggcattgtggcacacgcctttaatcccagtactagggaggcagaagcaggtggatctttgtgagtttggggccaacctggtctatagagtgagtgccaggacaaccctgtctcaaaaagacaaaaaagagggtgggggggatattgagggctagagaagtggttcagtggttaagggtgtttgcagaggacctgggttagttcacaacccccacgtggtggttcacaactgactgcaatagaagagggatctatggtgccctcttctggcctctgtgggctcctgcaagcacaaggtatatataaactcatccaggctcacacacataacacagaaaacaagtttttgtttgtttgtttgttttttgttttgttgttgtttttcaatacagggtttctcagtggctttggaggctgtgctggaactcgctttaggctggcctcaaactcacagagatccgcctgcctctgcctcccaagtgctaggattaaaggcgtgtgccaccagcgcccaaccagaaaacagttttttaaaactagtgttctagggctggagagacggctcagatgtaaaaggctaggctcacaaccaaaaacactggtgttctgtattctcttgtgagaaatgtgattgccacatatatcttcaactttttctccctgaagctgtctcttctgtcatcactcgtctatagagtatctccctgttttctgggcctcctctagattgggtgtgttctgtagatagtcaccatcatgcttctgtcctttgggcttttcttacccatttgctggctgctggttgagagcaggtgttccaaaaacagtcccgagcctatggggacaggtggtgacaggtatctgtctgggacatcttccacatgttgggattgcatttgtacttcatacaagtttatacctgtagggacttgtctgttgacctctgttacttcagaaacttctgggtgaggcttctgggattaagataagtaaatgccaaaatcactgttgcttcagggagacaggtgtgtaaacaaatgctttttgtacactgtaatgaaatgctgccagcctgccctcaaatatagctcaggaggcagctgcttcagggttccctgagggtaaagataaggactgtggagccacctgtcagtgcttgcatcccaagctgacttgggctaattcctgactttggagaaagtattgaactgtcattggcctcagttcccttacctgtggtaagagatcctgatcatgcttagcctgttagaatagggccatccctgtgtcactgccctccccatcaatattttatgtagtcctggctgatttcattgcacagccaaggatgacccttgatttctttgtctccacttctctcaagtactcctatgtagtccaggctggctttgaactcactgtataggtgaggataaccttgaacttctgatctttctgtcattacctcctgagttctgggataacatctgttccaccacacctcacttatgcagtgttggggaccaaaccaagagccttgtggatgttaggcaagcattctaccagttcagttacattcctagacctcactcctcccttgtttgtttccacttagggtctccacaggtaaccttgaattcactatgtagctgaagttggtattgactttgaagtgactctcttgcctcagcgccttgagtgctgagattataggccaatacccctaggcctagctttctcctgaattctttgtaaaggtcaagtaagagcatttaccaaggggctggagaggtggctcagtagttaggagcctgattgctttttcagagatcagagttcaattccaagtacctatatgacagctcacaactgtctataactccaggatccaaaacctacacatagacatacatacaggcaaaaacaccaataaaataaaaaagagaatttaccgagcatatagacatggtccttggaacacaagaggtacccaataagagatgactacagtcctttttgctgtattattcagctgtatgcagaaaccccaaatgacaatgatacaagggcaggtttacctctctcagtaggtagatttagcttgtgtggtggtcacatcatgtttttagaggttggtccatgctttgacagttggttgctgtgtgtccttggagttgagtggacttggcctgcctatggaatgtctccaaccactgaagtgactctgtattcggttttgttttttgttttgttttgtttgtttgtttggttttttgagacagggtttctttgtgcaacatccctggcttcctggaactcagtctgtagaccaggctggcctcaaattcacagagatccgcctgcctctacctcctgagtgctggaattaaaggcgtgcaccacccccacgcagcttgtattcattttttgtttgtttgttttttcttttttcttgttgttgttgttgtttgagtcagggtgttgctacacagccctgactggcctggagcttggtatgtagaccagactgacctcagattcacagcaatcctcctgcttctgctcgacgggtgctggattataggcctatactatcactcctacccccactgccttattttccttttgaaaataagatttattgcctggtgtcacagctcatgtaatcccagcacttgggaggtagaggcaagaattcaaggtctttcttgttcacacagaagtttgaagccagcttaggccctattaggcactgtctcaaaaaaatttttttaaaaaagatttatcgatgttatttgcttcctaattacaaaatgcatttttgttaaatacagagaaaatgattctttttccttaatttgttactgttgtttgcccatggaagccagaagaggtgattgagtcccctgaaactagaggtggttgtgagctgccatgagggtgctgggaatcgaaccctggtcctctgggtgagcaggcagtgctcttaaccaataagccatctcttcaaccctgattttcatttttaaagacgtctggcttcctaggaggataagggacttcaggggtcaggaggaggcagggaagccagagaggctcttacacatttctcagcagctcagcccattgtggagaaaatcagagaagaatggacacgtttgagaatgcatttcatgtaggatttttgtctcctgaggttggatttggggaagtaaggggaaattccatacttgctagagctcatctctctcttccttcccacttaggtgtgtcaagtgtgtcaataaatactccactcctgaggccttggaacaccatgttcagacagccactcacagcttcccctgtccacactgccagaaggtaggtgtcatagcatcttcctcacaggagtccccgagagggacagtgacctgactgaagactttggatagccaggtgtggtggcgcacgcctttagtcccagcacgtgggagatagagacaggcagatagatatctgtgagttggagaccagcctggtctacagagtcagttccaggacagccagagctacatagagaaatgctgtctcaaaatacaaaaaaacaaaaacaacaacaacaaaacagacttggctgatcactcagaggcagaacttgagttgtctaacatggcatcagagaattaagaaggctttgcagagaggcacggacacctgacttgggtcttgagggatgaataggagtttatgagaccaagaaagaacatcctctgtgtaggagaccagcctgggtggcaactcacagggaatgtgctttggctgggctcatgagtgcttacagaactgaggggtctggagggctgggtctgacactttggcctccagccttgtgggcagatgggatgatgtttccaaggagctcgaaaccagagttcctgagctcagaaggtggaaggtggtgagggcaggggtctcggaagctgacctgctgtgattctgtcttactccaggtcttcccctgtgagcgctacctacggcgtcacttacctacccatggcagtggtggccggttcaggtgccagatctgtaagaagttcttccggaaggagcactacctcaagctgcatgcccacatccactcaggtgggcaccctgcccacccctccctctctgtcctgcccttctgtcgcttttccatttatactggctcttctccattgaattcctcttcctgccctccatactgctcctcactcacctgtcctcacctgtgaacatggggctcccaacatcttgaaagcagagaataagatgggtggtggcgatcattataagaattcattgggccaggcagttgtggcgcacacacctttaatcctagcacttgggaggcagaggcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctgttgtacaagagctagtcccaggacagcttccaaagcctcagagaaaccctgtctcgaaaaaccaaaaaaatttttaaaaaaagaaaagaaagaaagaaaaagaattcattgggcagggcagggcagtggtgttgcacacctttaatctgagtacttgggagacagaggcaggtgtatctgtgagtaggaggccagcctggtctgtacagagtgagttccaggacagccagtgctacatagagaaaccctgtctcaaaaaagcaaaaataaaacaaacaagggagggaggggaaggggggataaggagaaaggaaggaaaggaaggaaggaaggaaggaaggaagaaagaaagaaagaaagaaagaaagaaagaaagaaagaaagaaagaaagaaagaaagaaaagagggaaaaagaaaagaaagtagaggtgagccccagaggcaggtaagggggacttgactccgctctctgggtgccagccctgctagactgggtgttggatgactgtcctgcaaattcctaccccctctcatagcttcccagcttgaggtgtagtaaaagtttttggattgttaaagttttatggaggagaaagagagatggtatctcacatagccaaggctgatcttgcactccagaccctcctacctctatctcctgtgtgctgggattacaggtctgtgctgcaggattcaggtgtgtgtgtgtgtgtgtgtgtgtgtgtgtgtgtgtgtgtgggggggtgtgggggggggggggagagagagcgcgnnnnnnnnnnnnnnnnnnncaggtgtgtgtgtgtgtgtgtgtgtgtgtgtgtgtgtgtgtgtgtgtgtgtgtgtgtgtgtgtgatgggtatgcacatggcatacatgtgtggccaaatggcagccttgggtgttagctcttactttcagccttgcttgaggcagggtctctgttgttcactgctctgtacacagatgagctttggcctttaagtgcccagggattgtcctgtctccacctctcatcaccctttagcagtgtaggattacagatgtgagttctgggaatttggactcaggtactcacactttgcagcaagcattttacccaccgagccatttccccattccaaggattcggtttttatctttaaaataagtattagatgggtgtggtgtacacctgaaatcctgactactcaggaggctgagatgggagggccccagggtttgagataagcctgggctatagtttctgtttcaacacaataccagacaaaaacaaaatccttacaagctagaacctgcaggtcacagcttacacggtgctcccaactccctccatagtaactgtggttactgcctagtttgggtgacagattagaaaagaatcatttatgtgtttgtgggagcttatgtcatgtgcatgaagtaccctcagagacctgaagagggtggtatagaaaactgtgaactgcccttctgaaagagctgctgcaagctctcttaactgctgagtcaagtctccagaccctctggttttatattttgtctgttcgacacactttcttactttcacctaagtgagcacatggtgtaactatattatctgcttatttccttccttttccatagctgcttagtattgatctgttccctccctatgagtgaactttcctgtcatcatcatcatcatcatcattgtgctgggaattgaacctcgggcctcatctaggccagataagccctattactgggctatacccttccccctagatccttcaatgagtttttcagccattattattattattttaagttaggtaacatttcagggtatagtcactcacctttaatctcagcactcaggaggcagaagcaggctgatctctgagtttgaggacagcctggtccacagagagagagagttccaggaccaaaaaaaagggggggggaagaaaacttgtttcttttggtactgaggtcttttttttttaatacatttttaattaaaatagaattacatgacagtcttcccttccctccctccagctcttcccagattagttttatggtatagatagttcagtgtgtttttttttctgacaagctttcagaagttggtttgtgtggcttgttcttaacagtgtgttggtttaaaacatgtatttaaagcataatttccttttgggatgatgaagattctgaaaggcaaggcatggtagtacacacctgtaatccaggccagcctggtctacatagagaggcactgttggaacacactctgctacctttggctgtcacattcaggcccatacacacacacacgcacacgcacacgcacatgcacacaccagcaacacaataatgacgagcctctggcttccctgcaatgttattattttttggcctagaaaggcaggtggctataccaagctgctgccccagcatgtccagagatctttctagagcaggaaacaaaatgacttcagaacttttttgtttatatgaggcagggtcttgttctgtctctcagactggcctggaagtatgagtcaatattcaggcaacatatcaataccttgtctcctagaaaacaagccaggcggtggtgaagcacacatttaatcccagtaacctggaggcagaggcaagcagatctctgagttcaagaccagcctggtctacagagtgagttccaggacagccagggccacacagagaaaccctgtctcaagggagaaaaaggaagctgtgggtaggggttgggtggagagatggcttaacagctaagaacactgctgtcctttcagaggacccaggttcaattcccaggacccaaagtttggctctcaactgtctataaccgctgttccaggggatctgacaccctcttctggcctccttgggcatcaggatcgcacatgtacatggtgtacagacttaacatgcaggcaaatgatgtcatacacataaaaataattatatatatgtaatttaaaaatatattgtaaaactggggttatggtgtggtggtgtgttgctttcctggcaagcaccaagccttgtgttccatggtgacacattcctgtaatcttagcacttgggaaggatgaggcaggaggattgaatactccaatccagcttgggctacacagggaaaacctgtccaaaaaaaaaaaaaaaaaataccctccaaattctctgtgccaagtcaggagaaataagaaaagctcctcctggaggattcagacttgtcctcatgggattcatgaggtgttcccatgtccccacaggtgagaagccctacaaatgttcagtgtgcgagtctgcattcaaccgcaaggacaagctgaagagacatatgctgatccacgaacccttcaagaagtacaaatgtcccttctcgtaaggaggggctgccctatttatggggaggggagttggattaccccaggggggtctatgtggaaggttagactgagggcctctctccttgggccctaccggaccctgcctggctcattccccccactactcctttgcccatcccttggcttagaaaagctggtgcaggccccagtgagagggttcatgctcctgttctgtaactgatggctttgggttccaggatgcacacaggctgcagtaaggagttcaaccggcaggacaagctgaaagcccacattctctcccacgctggtaagaggcttaggacccattggagggcctggctaagacaagttccccgagaacagctattgggaggaagagcagcacttgcatgaggcatattgtccaggcctggtctatccagccagtgggtttctgcacatgtgttcatgggagctagaagccaggtctgtgttggggtccttggcacagcagaggcaaattccatgcaactccagtcccaggggaagtagatgtaagcagctgaactagattgtgtgcagtaacacagaggtgtgtgtcagtgccatccaagatgtgtccaagggatggcctggaaaggcagaagggacagaggtctctaagccaccttcccagggcaaacaagagtgtttatcagcaccccatccactatccatgccaaccccatccactgtccatgccaaccccatccactgtccatgccaaccccatccactacccatgccaaccccacccactgtccatgccaaccccatccactatccatgtcaaccccatccactgtccatgccaacccccatccattttcatgagcaccccacatccatgctatttcagtgtggcatctcccccttagtgtaacaatcaaaaatgtcccctacaattcacctggagataaagttgcttctgttaaaagcttgaaaatgggagggaagactggcctagcatgcataaagccctgtggtttgagtcccaagtaaacataaactaagcatggtagcaaaaaaataaacaaaaaacctgaacttccagtacttgggggccagagaaagagttcaagctcatccttggcttcatagcaagttcaaagccagcctgagctatatgagatgcccctctcctttttaatgggaaatgggggagggtccatcagggaatctgacatcttggctctgagccttagtgctaccagcttcttgctgggtggtctcagggaagtagctgctcattttggcccccaaccccaggaggctgaagagtgaaggcatttacaaaaggggcctggcccagcagggctggtgtgagaatcaggaaagtcctccacagagctcaggcctgaggagagagaagagcgagaaaagagagaacaagaggaggccccatggataaggaaggaccagaggaaggaggggccagagcacagggtggaggaggggctgggcagaccacaccctgatttgtaggaaacacctcagagcagaatttgggcaccagggctcttactagtttgtgctttacaaaaacatctctctctgccattggcaatggcctgaggggcacaggtgaggccagcagcccagaggagttggctgcatgtggtcatccagggagaggttgtatgacctacagagtccaccaaggcttaagaattaagcagattaggggctggagatatggctcagaggttaagagcaccgactgctcttccaagggtcctgagttcgattcccagaaaccacatggtggctcacaatcatccgtaatgagatctggtgccctctgctgctggtgtgcagatatacatggaagcagaatgttgtatacataatannnnnnnnnnnnnnnnnnnnnnnnnnnnnnnnnnnaattaagcagattatttcaggcatgggacaagcaactgcaaaggcccaggggctggaggaggcacagtgtggtagagtgagtgacccggaaagtgaacgacgataatggagccagctgaggcctgaccacacagatgcctgtcagaacagaggctgggtgggacaggcgcggggggaggggatgtgcctctccctgacagcctctcactccccaggcctgaagctccacaagtgtgggctgtgcagcaagtccttcagccgccgggcccacctggctgagcaccagcgtgcacatacgggcaactacaagttccgctgcgcgggctgcgccaagggcttctcacgacacaaatacctcaaggatcaccgctgccgcctgggccccacgaaggacaaggacttgcaagcccggagaccttcccggaggagagcagccccacgtggtggaggcagcatcgttggagtgcacaaggaggagagcccggtgcccgacccactggggctggaggagctgaaggccgcagggcctgcacccgaggctgctcctggcaagccacccttcgagcaagacgccgtgctgtccattgtggtgggtggggacccggagctggtggtgcccgggcacaccgagggtctgggctccaacctggcactggccgagctgcaggctggggctgagggagcgtgtgccatgcttgctgtcccggtctacatccaggcctcagaatgaccaggctggattttccgggggagccactggcacaagcccttttggaaattactgtatcaacccaatcccatgtcctcctatgccctgtgatcagctggggagccctgcagcactcacagggtctgaggcatgcaccgtagctccaggacatagcagtgctaagagagatggccagaaaatgaggtgcccagagactggctgatggaggcttgtacttgggcctcctctaaaagaaggccgggtggttctacctgggtggcctcagactgtgctactcattatactggcggggcgtggtcaagtcctagtgtgtggaaccattaccagaacacttcctgatggcgtcctcaaaggactgtggggtgagtatgtaagaggcactcagcctgggcttagagtgtagctgccagccagacctggcttcagatttaccagtgtgacctcgagcaaggcacttcacctctttctgctccatgttcctcacctgttcaacaggacttaatatagtactacctcttagagtgtcctgaggacaaagtatgttgaaattcgcaaagggccgcgcacagtacccatggcttggaaagtgctcaataaatctcaataaatgtttttatcaatgatgtgtgtccaaacagctcaggcctgggccttagtgttctcttgcttagcctgaagggacaacactcccctctaaaccacaggctgagatgccctgtagtcctcacaccacggccagccaaggagaatcacagaggtgcaggctcgcccagacagccggtaactctaacagtctgcagcactcaagaagctgaggcaggattttgagcttcaggtcagcctgggctacaggctaccaaccccctctcttccacaagtgcagacctggggctccccagatgctatttacacatagtctgtgcaaatggcccctgggagagtttatacttgtgtgtggaacttaagaatcctgggccttccacccctccccatgctatcaattcagaagctctgtcgacagaagcccctcccttcccagctggtccaggtgggaggcaagccaggccatgtgagaggcaggtatgagaaagggcccttaactcatgttttccatctcttcacagccgtcctctctgtcacgttgcttctgttacagaaagggaaactgaggctcagaaaaggaccagggcaggacacagtagagttgactgtttgatggctgagtttcctagaagcctgtcacgatcttcagacctctgtgtggagacccaaggctggagctgagagccatgcctgacttcccacatgttcgaggaggatgtggtggtggctgtgtgtgtgtggggggggggtgctgtaggaaggacgaagacaatgaggataggtgagggtccaagtgtcctgtctgcaaaagagatagaggactcatggggacggggagttttggaagagatgacatttgagctggggctttgttttggttcacttgattggctggctggttgactagcaggctgattttctgacaaggcctcactctgtagctcaggctatcctgaactcaatatatagtcacgcctggctccaaactcctgaaagccatcttgtctcagcctcccaagtgctggggttacagatgtgggccaccacacctgctgccacagagtgctctggtgggaagaccagagaaggcaattaaggaagcaggtatgaagtctgggctggtgaaccgcccaggtgactagagattgggaggaatacctgaaaggtgacggttgctgattctttaagccttcatgtaatggccactgctaagcaattcatgtcacattgcctcagtcatcaggtgtgcgctattgctttcccatgcccaagctcacacagcctacaagttgcacagctgggagtcaagccagcatggcccacctccacatgctcctagcctctctgctctattgaaatatgagttggtgatgaattagagagaacatagggtattaagaaaattggcttttattctctacatatcagaggaatcttgggagaagtcctgtttgagattggagcatgaacattcagggaaatgttaaaacatctgcttctacactcagctgttcccaacagcactcacatgtacacatattttccagaaatcatgaaaaatcactcacttgtcataggcttatcatggtttcaaattagggactgaattcagtttggaagctgagataaggcaatgggggtatcaagggttatcaggccaaagctgcagagcaggtaagtggcagagacagatcacagaataaggcagatttggcataggactgtgtgtctagagaagcctgacactcttatagtctgaatggcacatgttagcaggtgggagactgagccccagagaaaagaaagctcttcatcatgggccacagagaatcaatggcagagggcccaaagcaccttgaatagcccccaagttgcagaacaatgtagcattgagaggctgaacatccagagagaacacagattggtgtcaggcagggctgtgtttgaatcctggctctgccccttctgtggtgaatgtttctgaatctcacctttctcagctaatagaatagtatctgtcttagttagggtttctattgctgggaagagacaccatgaccaccgcaactcttgtaaaggaaaatcatttaattgggggtggcttacagtttcagagggttagtccattatcaccatggtgagacatggcagcgtgcaggtagacatggtgcttgagagttctatgtcttgaccagcagacagcagaagcaactgtgacactgggtgtaacttgaacatatgaaacctcaaaagccgccttcacaatgacacatttcctccaaggtcacatctaatagtgtcactccctaggggccaagcatccaatcatgagtctaatgggaggcatttcctgtccaaaccatcacagtatcctacctgatgaggttgatgctgtgttttggggggagggagggtaaaataggtaaactggagagcacagactggcaactgctgggttgaattcagttaatataaagaaaggtgttcatcatgtgagaaaaagagaaaaagagctgacattctcaaataatgatactgagactgaaggtatagttgtgtggtagagcatggtcccgttttcaatcctcaccactgccaaagaaggtgaataaatggataaataccagaagggtggtggtacacagctataatactagcactctggaggctgaggcaggaagatcacgagttcaaggccaaacttggcctctgagtaagttcaaatcctggctgagctgccatagcaagactgtgtttcaaacaggcttgatgtgaatactttgtatgtgtgtctgtgcgtgtctgtgtgtgtgtgtgtgtgtgtgtgtgtgtgtgtgtgtgtgtgtgcgtgggtgttgggtgtattcgggtgtgtgtgtgtgcattcatgtgtgcatgtgtgttgtgtgtatgtgtgtgtgtgcgcgcacatgtctgtgtgtgtgggcttgtgtgtctgtctgtgtgtgtgcattagtgtgtgtgtgtgcattagtgtgtgtgtgtgtgtgtgtgcattcgtgtgtgcatgggtgtgtgcatgggtgttgagtgtatgcggatgtgtgtgtgtgcattcatgtgtgcatgtgtgcacggtgtgtgtgtgtgcatgtgtgtgcatgtgtgtctgtgtgtgtctctttgtatgtgtgcattcatgtgtgcaattgtgtgtgcatgggtgtgtgtctgtgtgtgtatgtcttgtatgtctgtgtgtgtgtctgcatttgtgtgtgtgtgtttgtgtgtgtgtgtctgtgtgtgtttgagactgggtttctctgtgtagacgtggctgtcctaaaactcattatgtagactaggctggccttgaactcagatctgcctgcttctgcctcccaagtgcagggatgaaaggcatgggccaccactaatgctttagtcccagtacttggtaggcagaggcaggcaaatctcagagttcaaggccagccaggtctatatatcaaggccctgtttcaaaaaatattactaatagcctggtgtggcacatgcctttaattttagcatttgaaaggcataggcaagtgaatctttgtgagtttgaggccagcctgctctacatagtaagttctagtccagaaagagctatactgtcagaccctgtctcagagcaggggagggggaggaagaaaaaaaagctggaatgttttcacagcatttgtgaagctcggggttcagtccccaatacttcataaaaccaggtggtggtgcacacgtgggaaataaaggcaggagaattagaagcttgcggtcattactaggtatatagcaaattggaggccagcctgcgatacatgaaacgaatctcaaatatgtaataaataagtcataatagtgaagttggaatgaactacaaataaaacaacaaatatggcaaaaatgtactacagtgggaaaacatatggtaggtttcttttatgccaggattcatattaaacattcaagcatgacagtaggggtctggccagagcaataaaacaagaaaaggaaatgccataaggggctcatggaatgactcagggtaaaggcccctgccaccagttcctgacttccacacatgcacagtggcacacccacacacatacactcatgcttaaataaatgttaaaaaaaaaacagagaacagaacactacaaggtttaggcagggtaacgtaatagtgagatagatatatacaaatttccggatcttcagtagcaattaaaaaccatgccctggatttatgccatgcagcagctttgaatgcttgggacagagttggagaagtaggaaaggaaattgagtcatttactaaagttatacagggtccaagggaaaccttcatgcagttcttacaaagattgacttagcagtaaatagaatgataccaaattcagaagctagacaagtaataattgaatctctggcttttgaaaatgctaatgcgcaatgaaaaaaggtaattaggcaattaaaggcaagatcagcacccttggaggactgggtgtgagatacaatcaatactgaacctcataaccatgatgatgcttggataggagaggtgatttccagggggttgaagaaaaataaaaatgtcaagtgtttcaattgtggcaaacaaggtcacctaaaaagggactgtaaacagggcattcctagaacaatgttttttctaagcataattcaatagaatgcccctcccttctggattaggcagaaagtgtggcaacggcaggcattgaactaatgaatgtagatcaacaaggaacagtcaaggtaaccctttgccattgggaaatgccttaggggactcttgaaggcccccatgccaaattcagtttggttgtctcttgtaatcatggaagaaactccttgccagagaaattaaagaacctaatgcctattgtaagaaaccatactgttctggatgatagaaaatctatagaagagagaacaaaaaatcaggagtaattgtaaagcaaatattttggcaaacttctataaataaagaccaaaattaaaaatatgaataaatgatattgtcattgaaggctttatagacacaggtatgcatgttataataattgcaccagaatcttggcatccaaattggcctcataaatgttcatcttttagggattgaaactttatctcaggtaaaacagagagtgaagtgggttgaatatataaggccagaaggacagagaggaaaataaaagccacatgtggctaacatagcaatgaacttatagggacatgatttgttatagcaatgaaatattcagattaacattcctccaatcttagaaacaaaccataaattaacatatgtttctggggaaaatattagaaggtattataaagaacagtcaccaaccattcaggttgtaaaaaaacagggaacaacagctgctgatctttcaaaggcaccaacaaccgtacctttaaaatggttgatggacaaacatgtataggttgagcatgacttttaacaacagagaaactgcagtccttagaacagctggtacagaaacagctaaatgctcttcatattgaagaatcaaccagcccttgaaattctcctatatttgttattaaaaagaaatctggaaaatggagaatggtaacagatctaagagctgttaataaggtgattcagccaaatggcttcctatggtctggaattcctctgccttctttattacttaaaggatggcctcttataattattgatttaaaagattgtttcttcactatacctttacaagaaaaagtcagcgaaaaatttgccttcacagtgcctacttaaaataattcttagtctattaagagatatcaatggaaggttctcccacagggaatattaaatagctccacactgtgccaatattttgtatgacagctgttggaaatgatacgtaaggaatttcctcaatctatagctcaccattatatagacgatattttactagctgattcaaatgtagatactatagagaaaatctttgaagaagaaaagtttgccttgttggagaatacaaattgctcatgaaaaaatacaaagaggagagtctactaattatttaggacataaaataagtctacaaaaaattagaccccaaaaggtgcaagttaggagaaatacatttcagactcttaatgactttcaaagattgtaggaaacatttcctatctatggcccactattgggatacaaaatgataaactgagtaatttgttcaaaccttagatggtgacaaggacttaaatagtccaagagaattattatagctgaagctgagagagaattgactttgatggaaaagaacttacaggatgcacatgtggatcatttggatccaaaacttgattgcattttggttattttaccttctaagaattcttctacaggaatattaatgcagaaagaagatattatcttcaaatggatctttttactacataaacagactaaaaatttaaaaacttatgtggtaatgtctctgagttgattctaaaaagaaaattaagacttcatcaagtattaggaatatatccagcagaaattatagtaccctttactaatgatgaaaatcacaaattatgggcagacagtgaaatttggcaaagagcttgcagtaatttgggggagaaattaacaaaaaatatcccaaaatcaagagaattcgatttataaagggaactaactggatccttccttgcattgtatggggaatacaaatatctgaagcccctacattctatactgatacaaaaaaaattggaaagtcaggatacaaataagaaaatttaacttaagtggctcaacacccttaatagtctgcccaaaaatcagaatttatgctattcttatggtgttaatggatcataaagaacctattaacatagttactgactctctcagtatgctgaaagagttgttttacacactgaaaccactgcatttattcctgatgaatcagaattaactttgttatttattcagttacaagaaataatcaggaataggaaacaccctttatataacacacatccaaagccatatgggtctgtgagaccctctagcataaggtagtgaaaaaactgatcaactattgatagtaaatgtgctaaaggcctcagaatttcataaaaaaaaatcatgtcaatagcaaaaagttctccattacttggcaacaagccaaggaaattataaggaaatgtcctacttgttctttatacaactccaccacctgcaggaagtaacccaaaaggtaatcaaaggaatgaatgtgttttatggatgtgtttcattttgtagaatttgaaaaattaaaatatgtacagcacaccattgatgcctattcagtatttcaatgggcaactgctttgagtttggaaaaggctgattctgtaatcacacatttgttagaagttatagccattatagctatacttgtaaaaattaagcagacagtggctgtagagatggctcagaggttaagagcaccgactgctcttccagaggttctgagttcgattcccagcaactacatggtggctcacaaccatccgttatgagatctggtgccctcttctggtgtgcagatatatatggaagtagaatgtcgtatacataataaataaataaaatcttaaaaaaattaagcagacaatactccagtatatgactctagtaaaatgaaaggtttttgcttattacaatataaagcatattacaggtataccacacaatcctacaggacaagcagttatagaaagatcagatcaaactctaaaggatatgctaaattaacagaaaggaataaaaatgaccccccagaaatagagtgcataatgctctttttaaaaaaataatttatttatcctcagttttatgaacattggcattttgcctgcatgtatgtctatgtgagggtgtcagatcttggagttatagacagttgttagctgccatgtgggtgctgggaattgaacccaggtcctttggtaggacagttagtgctcttttaagatttatttatttatcatgtatagttttctgcctacatgtatgcctgcaggccagaagagggcaccagatctcattacagatggttgtgagccaccatgtggttgctgggaattgaactcaggacctctggaagagcagacagtgctcttaacctctgagccatcttcccagcccagacagttttggtttttttttttgggggggtagggttcgagacagggtttctctgtggctttggaggctgtcctggaacttgctcttgtagaccagtctggtgttgaactcactgagatctgcctgcctttacctcccgagtgctgggattaaaggtgtgcgccaccaccaccaccaccaccaccaccaccaccacccggctcagttagtgctcttaaccactgagccatctctccagcccacacaatgttttattagctttaaatttcctaaatgctaatgaaaaaggaatgaaagttgtggagagacattggataatagaaaaaactatggaattaaatcagcaggtatacttcaaagatctgttggcctcagaatggaaaccaggacatgtgttacgttggggaaggggttttgcttttgtttccacagaagaagaaaagctatggataccatcaaaactgataaagactcttttgaacaggagaggcatattaattagaagagatcatagttcatcaaacatcatggctgttcaatctaaactaacctataaaactaacaaatgcttttcatttgatcagatataacttgccaaaagagagcttccccaaaattagggttggggaagggttctgtttctgtttttttcaggagaataaagggatccagctaaagaatccaaagaccactgcacaaatgagacatctgaagaaaaaggacaaatcaactagaaaaattgtcccaagaaaaggagcaaattgcctattggtatatcacgtttccaacaggataaaatttcataaatcttcccaaatgtttgtttctgctgttctctacagacatataatgcaaatggtctttttgtagtcctagtccaattaaaaattaaagctggttttggagttggagtgtggctctctccttctctagacccaagcattcttgttaaagtaaaatccaaaatctctgtgtcatgtcagaaaagccacctgatttgagacagaagaaaaaccaaaattaaggggctattctattgccactaatctcataatactttggttttattttgactttttaaagcttttctttttttttttttttaagacagggtttctctgtattggaccctgtcctggaacttaccctgtagaccaggctggcctcccggagtgcgccaccactgccaccaccacccagcttaaagcttttcttaatgtctaaatattacctcaaaatgtataagaataatatatatgcatatatatttaaacttctgtcatgatattaacggtcatatagagtactaactaattttagaaagaggcttcatctaccttcctgtaaataatttcaggtttgaggctctgtcagttttctgcagtgaacaataaccatgcctaacactgacctttgaagtctccaaaaggaagatggggccctacaataatgattccaccaggattatgataactccactaagctgaaaaacacctcctaaagatcagctttggattacaaactgctcagaacaatttcgaggtggctagctgagatgatccagtctcacagacgactccagccaggacttgagacaaaccctacactttcccattacacagagactggacaaatcatacagctatctctcccaggacttgacaattaacctgatttttttcttttcaggatcccctagagttgtcgtcaccccccagacagcaggaaataaatttaagaacatgacacttacattcccaagaaatggtgttggtggttttggtcatttaattggttatgagtatttgtcattgtttagggtacttggttacaagtttttattgataatggtcaggaaaaagctaaataggagaaattagattcagagtcttgttttgaaaagaaaaatgggggagggggtactgggctggagagatggctcagaggttaagagcactgtctgctcttccagaggtcctgagttcaattcccagcaaccacatggtggctcacaatcatctgtaatgagatctggtgccctcttctggcctgcagggacacatgctttcctatttgtattttctccaaagccagtgggaggtaacgacctgtgtaagcaaacagtgtaactaataaataaatcttgaaagaaagaaagaaggaaagaaagaaactggggggtacagatatgataggataaaaagggcagatttcaactctgaaaagaaaaaaggaagggccgggcgttggtggctcacgcctttaatcacagaactcaggaggcagaggcaggcgaatctctgtgagtttgaggccatcctggtctacagagcgagttccaggacaacctccaaagcaatagagagaaacgaggaaaaaaaaagaaaaaaggaaggatataaggatataggtatgataagataaaaaggtaggttattgaatctacttttaaaaagcaactaatagttttaaatattttacattggattgtacttttgtatattttaaacaaattttgtatattgaggggctggagagatggctcagtggttaagagcactgactgttcttccagaggtcctgagttcaattcctggcaaccacatggtgactcacaaccaccttaaatgagatctggtgccctctgctgacatgcaggcagaagactgtatacataataaataaataaaatctttaaaaaatttgcatattgatgcaaatttgagaataattttgttagaacatactgtacatagatactgtacatagatttctaatattgttcaaggtattatacctttacagctcatttaataatgtaatgcaagttcctaggtttttttgagggggaggggcggggatggggggtggaggagtgtttcgaggcagggtttgtctgtggttttggaggctatcccagaactatgtcttgtacaccaggctggtctcgaactcacagagatcctcctgcctctgcctcccgagtgctgggattaaagtgtgcaccaccactgcctggcctaaaattttagtttttgaaaggtattattaccaactatttaggataataagtaatgcagattagtaattagtcaccttttacaattatagtcacattaggtatgttttcaaggtcaaaagagagatagtttagatggacaagtcatcttcaaacacttcagagatctacagaatatggcatttaagatgttttaatgacataggttctttttttgttttttaagacaatgagacatgtctgcttctggcagcaccaatctaaatcagagaagatgatggacatcaaagaaacttcacatggagtttactttctttgtggcaaaaattagccactgggcattaaagtgctcttgccttgactactgacagtatgctgtccagattggacaaacaggactcaaaagacagcgactgctaaaacaaggcagggcagtccttcagaatgtcgtgcttcacagaaaagtctgttgaatattctaggcctgtaggtggaagacggatgcccagcattgcagaggaaccctgggtgactttccaggcagccagctgtttctcccatttctcacactttttggaagtcacttgcttgcactttctgcttactcagttaatgttatgtacttcctggatctctgagggagttgaagactagatagttatagctttccttgtttaccagactcagaaaagaaactcattaaagaggtgtaatgtgtaaaatgttgagagacatagaaatataattttgagttggtaatgcaagttagaatagaaagtgaattaggtacaacacttttggactcaccaagatagatatggagtattttctctgaatttgacaaatgcaaatgaactagacattgttgatgtatttattgcctgtatatattgtatatagttattatacatgtatagtttttcttatattagttatgtttctttttattttagacaaaaggggaaatgtggtgatattttgtttatgatctaacaaataaagcttgcctgaagaccagagtgcaaagctagccacactagaatctgtgctccttccactgtctgggatccagggatggattgtaggacgacaggcttagcatcgagcacttttattcactgagcaatcttgatagacccaagtttctgtatatttcaattcatttctttcctttcctcttttctttccccctctcctttttccctccccatcccttctcctgcctggaacacctggaactcacagagttgcttaggtccatttgaactgtcagcaatgctgctgacttggtttcccggagggtaagattattgattatgagctgccataccctgataacctcagtttcttcttttttcttttttgggttttcaagacagggtttctctgtgtagcagttctgactgtcttagaactcactttgtagaccaggttgtcctggaactcactgagatccacctgcctctgcctcccaagtgatgggattaaaggcatgtgccaccatgcctggctaatattgtctttttatttatataaataaaattatttagttttatttatgtgtttgtgtgtgtgccatacaagtgttggtgctcttggaggtcagaagcaggactcagaccccctggaactgagttaatggtgattgtgagccacttgatgtgagttctgggagctgaactcatatcctctagaagagcagaattcactcttaatggctgagccgtctctccagctccacacccagcttcttatataggtgctaagatccgaactcaggtccttgtgatggcattaaatcagcagaaccatctcttcctccttttgtttatttgagaaagtgtctcctagatgtctgagatgtagcacaggctatccttgaacttgctatgtagcttcagataacgttgaacctactgcctccactttccaagggctgtgccaccactgtacctgacattcctttatggtttgttgtcctccttgaaacaaaagctctatgaaagctaatggcttaatggtttctcagttgggctgagaaactggggaggaaagttggcttgcctgtgggctatcagtagaacctcccccgctccccctaccacccccccagaaatcttttgactgatataccaacctctgttagtatttacctcattgagagtacagaggaactgatattaatcccaccaatcaagaataagatcactgccaggtggtcttggcacacccctttaaacccagctctcgggaggcagaggcaggtggatctctgtgagttcaaggccagcctggtctacaaagctacacagaaaagccctgtcttggcaaattaaaaaagaaaaggaagaagaagaggaggaggaggagcagaaggaggagaaggaggaagaggaggaggaagaggaggagggggaaggaggagggaggagaaggaggaagaggaggagggggaggaggggggagaaggaggaggaggaggagaaggaggagaagaagaaggaaaacccataattcattgtatttcccatcaggttcaatcaagggcatgcatatgtcctgttgtacttccagcctatatccaatcagaggcaagcatacatcctgacctggctaatattgtctttttatttatataaataaaattatttagttttatttatgtgtttgtgtgtgtgccatacaagtgttggtgctcttggaggtcagaagcaggactcagaccccctggaactgagttaatggtgattgtgagccacttgatgtgagttctgggagctgaactcatatcctctagaagagcagaattcactcttaatggctgagccgtctctccagctccacacccagcttcttatataggtgctaagatccgaactcaggtccttgtgatggcattaaatcagcagaaccatctcttcctccttttgtttatttgagaaagtgtctcctagatgtctgagatgtagcacaggctatccttgaacttgctatgtagcttcagataacgttgaacctactgcctccactttccaagggctgtgccaccactgtacctgacattcctttatggtttgttgtcctccttgaaacaaaagctctatgaaagctaatggcttaatggtttctcagttgggctgagaaactggggaggaaagttggcttgcctgtgggctatcagtagaacctcccccgctccccctaccacccccccagaaatcttttgactgatataccaacctctgttagtatttacctcattgagagtacagaggaactgatattaatcccaccaatcaagaataagatcactgccaggtggtcttggcacacccctttaaacccagctctcgggaggcagaggcaggtggatctctgtgaggtcaagggcagcctggtctacaaagctacacagaaaagccctgtcttggcaaattaaaaaagaaaaggaagaagaagaggaggaggaggagcagaaggaggagaaggaggaagaggaggaggaagaggaggagggggaaggaggagggaggagaaggaggaagaggaggagggggaggaggggggagaaggaggaggaggaggagaaggaggagaagaagaaggaaaacccataattcattgtatttcccatcaggttcaatcaagggcatgcatatgtcctgttgtacttccagcctatatccaatcagaggcaagcatacatcctgacatatttcctgcctgtgaacctcctgaccacatgcaatcaaatacatctgctatagatgggccaaacaaaattgtttaggaaagtgaaaatatgtgacttgttatctctcataaacaatggcccccagcatttcaggagctatctgtctttaggcaaggaaggggcttgtagatcagcggcgttttgtttcatggatctcttagacatggtaattaaaacttaaaacataactttggctctcacactgacctacaaatgttatcttccattcccaaagtccccctttccacctaataaactccctaagcctccactactgcaggaacaattctgtgtagaggtgtgtaaagagtctttctctgtcccaccattcagctcccaaataatgacatggagatttgtttatacatatatacatttgtttatacatacatacatactcacagagatccggctgcctctgcctctggagtgccaggattaaaggtgtgcgcccccaatgcctggctagacttgttaataattaaagcttgaccttagtttaggcttgttccactaactcttataattttaattaacccctttatattaatccatattttgcctcatggctttttacctttctttcattctctacgcacaacttcctccatgtctctttggcacttggattcatctcctacttcctctttctgcctagaagccccacctatacctcctgcctggctattggccattcaactctttgttacaccaatcacagcaatacaccttcacacagtgtacaaatatcccacaacagaggttagtctctgatttccacatcgcctccatcaatcccattctaacaaaggcaaagacatccacttatagacctatctactatgcctaaaactgcccaggaattcttcagttaacatctgtgaaataaacaacacactttaaaagaccacgacgcaggttgcctgtcctctcctctcaccacagggcagctgagtaactttcctcaggtagattctgctatgtgggcttagccatgtgtgagagaggacagtccactggtctgaaggtagggcagaaacaatctgggaaaatgactgaagcaatagcttgcaagtctcagttgactgagcaggtccctgtggcctaggaaaacaggttggaccagttttgccccaccccgcagggaagaaggaatggaggcttcaaacacaggtgctcccaacccccatagcttcaaaccctttgtccaggttctcaggtcctgcacaatttgaatcacagaggttgacagagtctgcactcatggttaagggtttgacattctataggggtatttggggtacatttaagagccctagcccgggtgaccaaagaccaaagtccttgccctttgtacagtcatagagaatgcactctttgggaggaaagatcactttccaaggtctcacttggggcaagactcccagatcatccctacctctgtcctttcattaatccatttaaccaatactttcctagcttagaagataacatcacgaacacaatgatttgtatgatcctttgtggagattaaaaaaaaagaacacagtaaatacaacaattatgtggtttgttgtaaagcagaaaagaatagaaaggggagtgtgtggagtgaagtgcctggaggaagaggccagggggaagggaggctcatccctccccgctcccctttctgtgtgtgtgtgtgtgtgtgtgtgtgtgtggtgtgtgtgtgtgtgtgtgtgtacaggtctttacctacttcgccatccctccccgcccctttctctctctctctctctctctctctctctctctctctctctctcggtgtgtgtgggtgtgtgtgtgtgtgtgtgtgtgtatacacaggtctttacctatgtggccatccctccagccctttctggattcttgtgtctgcatttcttgacttagcctttcttcactttcaaagccaggaggagcatcttgcattctgatcctcctcctttgattacaccatgtccaactggataatccagaatatcctcttcctctcaaagacctttaaggacattctgggtatagggcataggtatctttggaaagttactgtgtggcacacttcagggagctactgccaaaatccaagcatgagatagataatagtgacctggagggaagtgacagcagtgaagagtgacagatgctggggctctggggacactttgagggtcgagccagcaggatgttctaaggcattggacatgtgttaattccacaaattgacaagacaactacaacttaaagccaaattttgaagcaagctttaattaaatactggcccggtggttgggctctggccaggtccatacctaggttcctgggaaatggccccatgtcactgtttgcagtggcttaaaccccataattcatcacatttcccatcaggtccaatcaagggcaagcatgtgtttcctcctacccaaaggggatcaagcacatctggtgcagatgggtcaaacaaacatatgaaaaacatgtggcttcttatctcccataaacaatatttcaggaactatttgtccttgagcaagaggcttgcagatcatttttgtttcatggatctcttaggcatagtattaaaacttaaaatgtaactttagctctcccacatggactttccttccatctatctggacttggaagcagaccctcccttctgtgagagagagtaggcgcctctataaaggtccagggagtgatcactggagcctgtgtgccccctccaatgtgttgttactgttagcattcaggcatctgtactggcttgtccttggggttctgacagaatatgtcctcagctgcagccactaagagcacattcactatgttcccttttaaaagggccccaactcccatctctccctccctctctccctccctccctctctgcctgtctctccttctctcttctctctctgcctctcctcttctgccactcctgtccccagaggccagtctcccctctctcctcctcccttttgccattcactttctcccaattaaaaaaaaaacaacaaccctccacctcttgtttctaattcaaattaaaaaaaacaaaacaataacaacaacaaaaaaccctccacccaagctccattgcatggcatctttacaacagtcacttggtttacatagactcagcggaacccaccattgtctcaagtagaggccccatccagcacacatctccctctcacacccctcaggttgggtctgtcttatctccattgctgaatttgcccagatttcactaagtagccctgtgtgacctagaactggatatggagactgcgctggccccaaacacacagggatccacctgcctctgcctcctgagtactgggactgaagatgtaaatcagcatgtctggtataaataaataattttagatgaaaaagaaaaaagggttgtagggtgtggggatttagcttagtaggaaagtgctttcccagcccatgaaaggccctgggttcaatccctagcactaaaaaaatgaaagaaaaaagatactcagcagggcatagtggtttgtgtctgtaattccagcacttgagaggcaaaggcagaaagactgccatgagtttttgtgcctagcttctttcattcaaggtaacacatactgtgcttattgttttcacatggcttcaacactttcgtttgttttgaagacgggtttttctatgtagccctggctatcctggagctcacagagatccacctgcctctgcctcccaagtgctgagattaaaggcgtgcgccatcaatgcctggctggctttaacaatttgttttgttttgtttttgtttccccgagacagggtttctattgatgcctctgggaccagcctctaggcagctcagggttctgagagaagccaaggcaatggtgaagctaagaccttttctatctgagagggttagggagaagacattcacattttcttcatcatttccttttttattcattaacctcttctgatactgaaagacccctggaggctcaggcccccaggatgttggcccaggactgaggtggtggcaaaaacttgatgcaaacagcacgaggctttattatagttttttaacgagctaaccccatgttagcttggctctttcatccacccaccatggctgatggctaggaaagacagctcaaagtgtctgcatagagatcttatagggcagcgtaaggggagtgtctaggggtacgcacaggctcaggattggtgtggcttcaggcttggagggtttgccctgtgttgattggtcaactggttgttatggaccataggccctcccagggcgattgctatgctctgcgtgtcattgctgtgcacctgtccaagaagcacacccagagccataaagcgtagcaccaccagctaacttctgattggttctttgccacgaggcaggcatctgacctcctagtgaccaaggcaaggtcaggcaagcacgtgctaggctgttatggctgccgaaatggggagctggaaccttcaatacactctctgggctggatctggctgttatgtttttgtttaaattagatataaaaagaggggagcgcaagttgagacatattagccattttattataagcccggcagagtagggagactaagagagaagagaaacggggtaaatggctgaccgccatggccggtagccatagagagagagaagagaagcagaagcaaacagagcgaagaagcagcagagagagagcgcaaagcaaagaagttggaactttcaaagggaagactgtgcatacgcactgaggttccacgcatgcccagagtcctcatgtaggctgtaaatgcatggtgggtgatggcacgtcgcatgccctgactgttgtcagggggcggggtctgtctctcaaagaggtagagctgatcagcattaaagcctgaacctttcactggccacccctttaaaactgcacaaaagtgtattttttgtttgtttgtttgtttttggagacagggtttctctgtgtaacacccatggctgtcctggaactcatgctgtggaccaggctggcctcgaactcacagagatccacctgcttctgtctctagagtgctgggattaaaggtgtgtgccaccactgcatggctttttcttttcttttttaaagatttatttctttactatgtatatcatgttctgcctgcacaccaggagaggacaccagatctcattacagatggttatgagccaccattcaattgttgggaattgaattcaggacctctggaagaacagccaggactcttttattcccccctccccccccttgcccggaaaccagaacattttattttatgactgactgaaatcctcaagatgaactggatgctgcaacagctgccctcttgggtttaggtgttgtcccttcatggaatccatgtttgaatcttcgacaatttttaggtgcctcagccacccagttccgtcagtgttttgtctcttagccttggcacaccagttatactttctcttgcgcttggcagggtagccacatttgccattctgaagttggtaggccttagagccacagcggcagcacaatgctttccaaaggatgatgttcctttcgtcatcttgcttctacagctgaggccaaagagccagccagtactcttaacctctgagccatctctctagcacaaaagtgtatttatcaattgttacacaaagcatttcccaattccaaggttccccatcttaatctacatatcttattgaagggagcatcacatgtctccatgactttcatccttcattaagcattgtgtacaatacacaaataatacaagagcctctggtgtgcctgaggtgtcctgtgagcaaggtcatgggatggcaccctcagtaaaacaatcattggtctccgcttggattcctcaagtcaaagcactcctaagaagcatctgtttactctagtctctatcccatatagtgattttgctaaattcttacagagtacattcatcttacatgactaatgaagtttctgcaccccgattagcctctccactgatgcagcaatccaaatcagaccaaatcaaactgaattagaaaaagcccacgttgaatggataaaaaacgctcccacatgactttccaaactcccagggaggagactgaaaagagagactagaaaaccacatgtctattttctgggggtcagtttaaataccctgtgggagtggtcttgagcatctctgggggaggggtcatcatttgtcgggcttctggagatatggcagggtttggagagagatgagggagggggtttgaggtggaacttccatcagaacattccagactctctaggtatatggttgccaggggttgggatgaagcttctaccagaatatctaataataaaatcatcccaataaatctcaagaaaaaaacacaaaaaacaaaacaaaatttatcccaatatcccatatacatttacatcttgaagggaccagctccccatttcggcagccataacagctgaacacgtgcttgtctgaccttgccttggtcactaagaggtcagatgcctgcctcgtggcaaggaaccaatcagaagttagctggtgggctatgctttatggctctgggtgtgcttcttggacaggtgcacagcaatgacacacagagcatagcaaccaccctgggagggcctatggcccataacaaccagttgaccaatcaacacagggcaagccctccaagcctggaggcacaccaatgctgagcctgtgcgtactcctagacactccccttatgctgcccttcaagatctctatgcagatggttcgagctgtctttcctagccatcagccatggttggtggatgaaagacccgagctaacatgggttagcttgttaaaaaactacaataaagcctcgtgcagtttgcatcaaactttcgaatccacctggtgattggggtgaccatggtcctgggaaaagatcctggaggcctgagctttcctgaggtcttacaatctaagtaacttattgcagatcaatagagcataagcagacagaaatcgtctctttacagacaactctcttgcttgctggcagggtctattcaatggctacaaagaatcagttattctattgtctatctagaaagttaatttttttaatggttttttgagacagggtttctctgtattattttggagcctatcctggcactcactctgtagagcaggctggcctcaaactcacagagatccgtctgcctctgccttcccagtactgggattaaaggtgttcgccaccatgaccagaaacatttttttaaacaaattcttttattgtaagagcattttgtctgcatgtatttgtactacatgtgtgtctggagtctgtggaggtcagaagagggcactggatctcctggaactggagttacagttgtaacccatcacatgagtgttgagaactgagccttgcaagcaacaagtgctacacccctgtttttcacagagcttttaaatgaggtaatagtagttgcttaaaaatttaaaagggcctgcacttaccccaaaggccagaacaatgaagcccaggctttctggtatttaaccaatgtacactgtgagtcttgccatggcagttaaatcctcaggcgagatggcagccacccatgtgtcaccatgaggtattccacaacctaagcagacatcatgacttgctcctcttcttcttcttcttcttcttcttcttcttcttcttcttcttcttcttcttcttcttcttcttcttcttcttcttcttgagattgagaattatgctatgaaggctaagctggcctggaacttgtggtctcctgtgtcagtcttccaaggccacactgtagacaacatactgcacctggctttcagcaccttttcaaaaacagtgccagggtaggatcaaaattcttcttcggtgaccaatatcaattgtatgggaacagcactcaaatttgagttttctcctgtgatttccccacaagatgattttctggactcctagggtgtctcagttggggttactattgctgtgatgaaacagcatgaccagaaagcaagttggggaggaaagggtttatttagattacccttccatatcactgttaatcatctaagggagtcaggacaggaactcaaacagggatcaatgcagaggccatggagggtgctgcttactggcttgctctttcttcatggtttgctcaacctgctttctttctttctttccttccttctttctttcttttttaataatttagttatttttatttgcattggtgtggtgcctgcatgcatgttgtgtgagggtgtcagaccttggagttacagacagttgtgagctgccatgtgggtgctaggaattgaactagggtcctctgaaagagctgtcagtgccttaaccactgagccatctctccagatcctcaacgtgctttcttatagaaccaagaaccatcaccccagggtggccccactcacaatgggatggaccctccccatcaatcactaatgaagaaaatgctctacaggcttgcctacagcccagtcttaactgaggttccttcctctccaatgtcaagtagtgtcaagttgacataagcttattaggacacagtcaggacacaaggactctgctgtcaacctgtttagctcaacagcagtgtgagactggtggttaagatttgtggcatctacactgggaggtggtggcacacgcctttagttccagcactccggaggcagaggcaggcggatctctgtgagttcgagaccagcctggtctacaagagcaagttccaggataggctccaaaaccacagagaaaccaaaaacaaaaaagaaacgaaaccctggaacggcattaactatcatacactgattatgaaaatcaaatgtgatcatgtgctttgggggctgggaatttaacccaggcctctaccacggaatccctctctgtaatagttatttcgctccctgttcttccgtctctacggagcacattccaaggagactacgtcttccagcatgccacctcaccctttgacctcggcgcgactaaaaaggtgcgccatcgtacgccatgagccggaagactcggactcccggcatgcagcgcacagtcctcccttagacaaaatgggctgtgggcgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgggacacggaggagatgctaagtaagaagcaggagttcctggagaagaagatcgaacaggagctgacggctgccaagaagcatggcaccaaaaacaagcgcggtgaggcggccccgaccccatcagactctccactgcctctcctaaggtcccccaggctcggactccactttgtctgactcgtttcggggtctccttcaaccctggaactcttcggctagacttcttccggtgcctctcccggcccgggaccactttccaccagactcctgtgtctccttgagccggctcacttccaccatcagactcccttcaaactcttccctcccctatcaggcctctcttgacccagatctcacagcacttaaactccgtgctcagtctgttccactctgttttactgtgttctcgctttgacctcacccaccttcccagccactgcctccacccccactttggctcatttcttttcttcatcctatcattttgtgtctctcggttcacctctgccctcctccgagcccttggtggagtctgagctgccttcggcctctgacttaggagtctttttgaaaagcctcctttatggagagaaaagaggataggggagtgaagagactctctggtacccgctctgttcacttgtgaaattgaacaagtttgagaccttggtttccgcatccactagctcggatctggccgctgtgaggcccaagatgtcactagccctatgattctcttttggttgccccatattcaggccttcttggagcttccgtattgtcagccttaccccctgtgactcaccacttccctgtcctctgctgaataaggagattggtccagtccagtcttgatgtgaattgatactacttcctgttgtgagtctgtctaggaaagtgccttgtagttttcgtaagggaaatgaatgtgaaaatgttttagtgactgtaaagaaggtttgctttttgtcacagcaacgtgagtatgaatcatagcgtggagttcttcctttgagagtgggccaaaggtgggaggggtttaggagtcgtacagacaaatattgaactcagaaggccagcagggaagtttgttctgggattgtgaactagtggatttgcctttctgaaaggattactaatacccagcacatagtaggaacttaactaacattgtaaacatctgcttgatgtattctcagaatataaaatggtctatcctgataggaggtggtggcgcccacctttaaacccagcactcgggaggcagaggcagatgggtctctgtgagttcgaggccagcttggtctacagatcgagttccaggacaggttccaaagctgcacagagaaaccctgtcgaaaaaccaaaccaaacaaaaagatggtccatccctaggatgctccttgataatagcaaacattctggaacttctgggtacccagtgcatccagtcacattcatagaggggaatcagacagcccccacttcaagcagagagacagatactggctgtgtgtgtccctgtagacctgtctgtaaccgggcactgggaggtagaggttggagggtcaaggccatctttgttgagggagcaatttcatggccaacctggcctgtgagagactctgtctctaagagagatggtgggggcaggcaagatcagagtaagtgaagaagctagccatttaggaggtgtcattgatgagcattaaacaaggaaaagttggtcatagtgagggggagcggtgctattttggtagagtggtcagggatagcctctttgaaaagttaaagtttgaactgagtcttttgaaaagaaccagctttcgggggctttttcctggctgggagaacagcataagaatggctggaaagttgtcaagattaaagaaattgaaagacctctgtagtgattgaggggagagcagagtaaataaaaggagggtatagtaggtaattaccaatacggagtcaggtagaaatataagggtatttaatagggaaaagccttacttacagagcgaaccagccagccggtggtagtctgtacagcaagaagcaaagagagagaccgaaaccgaaaacgcagtccccctactcattctgaccacgccctcataagccctcaggtactcttgtagccagcccctaagaaggcgtggctacagcttcccctacaggagggggacaggcctcgaatggctgacagtttggattctaagtggatggaaagcttttgaagggtactgttcagaagcaagccctaatcattggtaagagttttaagcatctggctgctctctggagagtgggaggggcattcgaggaagttgcaggcatccatctgtggactggacaccagttgtagctgtggagaagaacagagctgtgttcgttaatcagctcttttctctgacaactctcccttaatcagggtcctctttcaccagcggtaattagtcctggtttttgcctatctgcatgtttgaaagcttgcctcttcacagtggagtggaggagggtgtcactgcacatcctctcccatgccacaggaccccaagcacaacgtctgccacacggtaagagagcaataactcaggtctcttggtctagggctagcttagtgtctgccgttgcagaggtaactgaattggctttcaagatgcttgtagagacaaagctgacacactggagaagcaaccccagctgtaataactttgttcaaagtgatgtctgtctttttgagtttacctgtgagggtccacgttcttgtctttcttatggtcctaaggtctaatagttgtgttgttcttgtcctagcacctaacctgcttcctccgaggctgctgtgaggttctaccattaccacatgcataccacttacttaccaacccagactgttgagactctgagcatcagagatgagaaaacactgccttgtcttcctgggagaagccaggattggaaatggggggtgaggaggtggggagggccaggagtaattttagaagtcagtggtgaagtgtgtttaaatggttgaggttacagagggggaggttcttgtctggagggaaggtagggaggaggctttgtggaggaaggagaatgcggtgggccatcaggggtttagtgtgttgaggagcagtgtaaccttggagggtgacttctagctttggatcttgccctggatatgttggagagctgttggtgggagttccaggacaggctccaaagctacacagagaaactctgttgggggagggggtgggggtggattcgaatcttacagatcagggtttgagctataccttctttactgactagctatgtgtctgggcaggttactctgcctcccgttcctctgtaaatatgagtcctatcaacaggacagaataaggtatgtttgttgtgtatgcaaagtcagcacagagcttgctgtatggtaaaagatcaataactgctagacattaacattattacactgatactagcagttattcgggtgggaattaagggcctagaatagacacatggaaaatgggcaaagatatacatgtccaagacttctaaaggagagtcagaagaagcttggtggtttggtagggttattggcagtagcatgatgcagacaggaggaagacattcccaggctttcagctggggcagccgggtacatggtgatgcatggataagttaggaggtaagtggcatgtcatagtgtaatcctttgaaatttgtaaaagctttctgatgagtattacagcgtctactgaaactatggctccctgaggtgggattttacagaaatgttcactgctctatgcccagcagtatctggcttacggttaatgttcagtagatatttagtcatgaatgagaattgatttatctatttatttgtttgtttatttttggttttccaaggcagggtttctctgtatcaacagctctggcggtcctggaactcatttttgtccaccaggctggccttgaactcacagagatgctcctgcctctgcctcccaagtgctgggatcaaaggcgtgagctgctgctgccgcctcggccacctccaccacctggcaaatgagtatttattatatgactaaagccaatcttgggactggagaagtggctcaattggtaaagtacctgccatacaagcatgaggacctgagttcagatccccgcacccaggtaaaggggctcatcagtatgcccagctgtaaccccagcactggggtaaggcagagacaggcagactccttagatccgtggccagacagcctttcttaattttatagcttcaggttcagtgagtgatcctgtcttaaaaaataaaatggagagtaatagaagctatttaactttgacctttcaaccttgtttgacctctagccttaatatgcatgtgcacatacatattcatacaaccacacacaggtacacatgaaaagtatctggctggtatgttcttttatgcccggtgtaaagggaggaaaatgaggcgtaggaagtgatgtgtctcaactcagagacttgttcaagggactaggggcatcatattggctgattccgtgactgccagaggcttcacatggctggcattgtccctgcactcagtacataaccccatttatgcaaggtgtgggatgagaggggggaaagtgagacagcaccaaattctgcccatcagaatatgtatccaaattcagaagccatcttggtgatatacacattgcaaagatggtacactgccctttggaagaaaacatgaaagccagattggattatttgcactgtgtcccgggcagtggctccagtcagatgaagagagcaaaatttgggtcacatattttttttccagttcctttttgtttcctttaatcatatatttattctcatgttctggttctggtcccttactcagtgctaagaatacagaccaggacatagaccctgctacacaggagacttataaacttatcttcacttgtgaaatatctacctggctgaggtgaggattacctaagatatgtatgaaagaacaagatatatggcacttgtctgatagttaccgctgatcagatttatatggtttaattgttaatagaaacaacttcagatcgaggcctaccaacaagaaccatccaaatttttcctgggcacctttgtagacagtactctgttagtttcccaagaaaggtgaccgtatgtctcagattctcttcttgttcctccttttttccccttctttttccaacgcccacctccttgggttttgtttttgttgttttgtttttgttgttttgtttttgtttttctggagacagggtttctttgtgtaaccctggctgtcctggaattcgctctgtagaccaggctaacctcgaactcagagattgcctgcctctgcctcccaggtgctgggattaagggcatgtgttactaccatctggcccccaaacctcttaaaaagagatttatttactttttgtttatgtgtatatgtgtgttcctgtgtgtttatgtgcaccacatgtgtgcatgtgctttgggaggctctagaactggagttacaggaagttgcgagctgcctgatgtgggtgttaggggaacggtacccaggtcctctgcgggagcagcaagcaatgagttctctccaccctttttcttcactttaaaattaaattgttattgttgtttttatgattatgattatcactgttgttatcatttgggggcactcaaagcacagcacaggaagaggtcagaagacaacactcagaacttggttctctgcctctacttttctgtgggttctggggctcaaactcaagtcatcatagcaagcaccatctgaaccatcttgccagttccttgttttatttttttaaggggagtatgggcagtgagggtgtgggacttgctatgtataacccaggctacccttgaacttgtgaccccttccttgcctcagcctgctgattgcagggattctgagttacacatgtgtaccaccacacctttattttttagtgtttctctgtgtaggacagcttgatggagttggttctttccttctaccatgtgagtgggggctggggtgaactcaggtttccaggtttccaggcaagtgccctttttacctgttgagccaacttactgtcccagtttcttttctttttatggcatggtagctaattaaggaagtatctactttaggtagttcagattttctcttttcttattttaataaagaggaagagagtttgtaggaagggttaggtttttagttacacacattgtgtaagattaagcaatggggactgtggtcacacgtgtacatttctgtagatcatggaagcaaccagttcgtttactgttaggttctgctgagaatgtcggagtcggaacaatgcagaggccaggagcttatgggaactacatcttcattaaattctgctcattgctgagaccagggtagcatcctcatggttaataaagtcactaaatcatcagcatatgagacggcatctttctaaattaaatggatagtgaatgtggccttttggttcttgataatcaacatctaaaaactacagtatcttttatttttttcagacagggtttctctgtgtagccctggctgtcctggaacttacagagatcctgctgcctctgcctcccaagtgctgggatcaaagacgtggaccaccaacgcctggctcaaattacagtatctttttttttttttctctctctttttattattattaattcaagttagggaacaggcttgtttcacatgtacttcccctcttcctctccctctcccaaattacagtatcttaatagtgtgtgtgccagctggactgtctgtcccagaggcccttggatggaaaacttgaaacccatccaggaactaagcagtgggattttcccttggtgacactaattgtttgaggacatagttttatttatttcttaagacagatggggtgtcagaaaggccctgtgtgttgactttttaaacatactggtgtcttcaattcaaatgaaaaaaatccgtttttggtaagattgcatgcacatgtatgcacgtttgtgaagttttgcatatgtggaggccagaggtcaacactgagtgtcattcctcaggaggcatctgtcttattttatgagatagtgtcttccacctggcctgcctggcctgtaagcctcaagggttcctctctttctacttctctagtgatagaattaaaaatatacttcacctctcccagctttgcatgcggatgctgggactgtaactcaggtcctcatgcttgcatagtaagcattccactggctgcatgacctgcacagcctgggtgtgcatgtgtgtctgtgtgggggtggggtgtggtgtgtggagagagagggagagacagacagatacccacctatgtttgcctcctgagtgctggtactaaaagagtgttccaccacctactgtttttaaaagagaaagctgaatataatggtctctctccacctgtgattccagcacttgaacggtaaaggcagaagtttccagctagctttagtgagactctgcctttaaaaaaagtgtagaacagagaggaagagaatattcaaaaacaactttagtgctccatgcatgtgtgcgtgcacacacagcactcaggctgaaaaaggatttccatgagtttgaagccagcctggactacatagcctgttcaaatcaagcctggactaaaccaacagatgctttaggttagtcattattagtcattgaagatggatgactatatctgttagttgttgaggatgggtgattatatttggaaggaaaatctgagcacattgagaagaaacatcaatcttagctggcatctaaggcagtgggctcaagtcagcagcatctattgtgttccttgtagaagtccacatagtggtgtaggtggatagtccctgttttcatgctgcttttcctcttaccatcagtgccttgaagcttactcaccctgagtctcttttccttgtaaaaagggaatgctgtgacttccttcacagggctcgagtagaaacaagtcagcatgtctgcaggacagaggacagaggccagcacccgaagagatgtgtttcctcccttggttttccactcacagtcttgagctctgccttctccttcctatggggattcataactctgcaaggacagcacatgaagtagcagaggaaaacagcagggagagatgactctcctttggatttggctggttcatttcacccagccacccatccagggcccagatttcctttgctgcattcctgcattcctgctgcctatcgattagcctcctattgaatcaccccaacccttgccatcaggatttgcgttaggatttctggcctgtgttatagtttattttgtcttggacagctctgccagggctgagagctgtcttcccgaaggcttacgttggatcagggtggatggtcttctgtggtgaagcagcctgggctgaagtcagagagcttggggtctgatactagacaactgtgaactggaaagtgggggtggggggcaggtttggcaccctcgggccacggaggacaggtctggcaccatggctgatggagaaatctggtgcttatgtttcaagtctgcacttcttgaggacagacaaatgtttctcttaccctttgtggatgttcacccattcaatggtgggtgcctcagaatactcagaatagtccagcagaaatctgaacagcatagctcagaacatgcagggtcatgccatttgcttagggatttagtacaagctcttgagccaggtaattcccctatccccaagccagatcttcttctcaaaattgtgtgtgggtgtagcatgtgttgtaccattgagctaaatccctagttcccttctagccctttaaggagtattagctaaaggatggatgattgaaatcaccatgaatacctggctggcttgattctcccatagctggtatttccagctctacctcctccctcttccttgtaggacaaaggaaagctgtacatctctttggttgtggtgtttatatcagaagattggtgaggtgggttagtggcaacggtgctaggtttgcagtcagaagacctaggttcaccatctgcctttgcctctgcctcttggtactctggaatcctgcccaagtttccttatctttatgagcgttggcttcttcagttgcaaaattcagaatacagtatctgctatactttcttggtgtttgatgtggcatataggaacatgttgggggttgttagaaatgcatgatatctgggcagtggaggcgcacgcttttaatcccagcatttgggaggcagagacaggtggatcactgtgaggttgaggtcagcctggtctacagagcgagttccaagatagccagggctgtctccaaaaagcaaaaataaatagaataaaataaaccagacacagaggccacatcctgacttcttaaagcagaactgttgtttttgtggaatttctctgtagtttgtatgttccttgaagtttgaggggtgctcaagtgtgtatgtgtacacacgtgtgcgtgaaccacgatgcttgtgtggaggtcagagggcaacttttgggagtcatttttccctctgcatgttgaggctccatctccctgcttgctatgctttcctgtgtgctggcatactgcaggctagcaggcatgtgacttgtggttattgtgttgtctccatctactgtgggattatagatgttttctactggcttgtttttgagtcccagggattgggactgaagttactgttcttgaatggcaagcgcttttacccacaaactatcttgcttgccttgtgggatttttttggtggtgtttgtttttgagacagggtctcactttgtagcctaggctgacttcaaattggtgattcttctgtctcagtcttcctagttctgggattactgatttgtgccaccatgtctagaaagtttgagggatttcaaaaccaatttggctatcatacatcttgggggaactctggtttttccatttccatttgagactacactcttgtaactcagctggccttgaactttgcttctacctcccaaatgctggggttacaggcatgccccatcttggcccagtgacattccaagtcttgttgatctgaatacttgatagacatttgtgtttaatttcaaggactctatttttaagtgctaaggaccaaacctcgtaacttatgtatgttagctaaacaccccaccactgagccacactcttagccctgtttgtagttggatttttctttgggctgcaaacagctcccaaataaagacacagagacttaactattaattatgaatgctcagcttgagcttaggcttgttccacttaattttaacttaatttaacatatttttatttgtctcagggctttgttttacttgtatgtcctactttcttgcttcttccatgtctgtctgtctggcatctccctgttgtctctttctttctccttgagcctaaattcctcttcctacttactctccctgctcagaaatcctgcctttatcttctcccttgctgttggccattctgctttttattcaaccaatcaggtaacttaggcaggcaaggtaaaacagcaacacatctttacataattaaacaaatgcaacaaacacatcattatgttgttaaacaaatgcaatgaatctgcatagttaaataatccacaacacctgtttgttagtttgtttttgaactcctggtccttctgtccctgcttctggggtgctaggatgacatgtaccctgatttatgggtgatgagccttaaaccccagtcttgtgcattactcaagcactctaccaactgagaacatgcctagcccaaaaggtcccccccccccagataaggttcactacattgtctagattgaccttgaagttgtgatcctcaagctccagaagacctgggattacagatctgtcccattggttctgctaatgttcatcttaacaagaaagcactggggaccagttccattcctatgtgggatgagcaggcatgttttagtgggagaggtgtgctgatactgtctagttgctaggcagagtgcaggcaacagatcattgttcctgaggagtgtacaatctacttgaggtgataaacagatagtcagggcacaggatgatctgttctagaagcatcttcagaagtgcttggcactggcgttgtggcacagtgtccagcacttgggaggcagagccaggtggatccctgtgagtttgaggacagccagagctgttacacagagaaaccctgtcccgaaaaacaaagtaaaaaaacaaaaataacccctcaaccccaaaaaacaaacaaacaaaagaagtacttggtaatgcagtggcaggagctaaaatagaggagaggggagaaacctttacatttatgttttgttttgttttgttttttggttttttgagacagggtttctctgtggcttttgaggttgtcctggaactagctcttgtagaccaggctggtctcaaactcacagagatccgccagcctctgcctcccagagtgctgggattaaaggcatgcgccactaacacccggctacatttatgttttattagatagttattatgaaatctgatggaatttaagatagaaaggaatatttaagtgtttgaatttacttggaattaataagatttttattatgtatatggcttatttttatatgtatgggtgttttgcctgcgtgtatgtctgttgctgtgtgcaaacatggaagtgtatgctgtgttgtgtgtgtgtgtgtgtgtgtgtgtgtgtgtgtgtgtgtgtgtgtgcacatgcgcgtgcacgagcatatccttggctgtcctggatcaaaggtgtgcaccaccaccacccagctatgtgctgtgctttttaaaagctttgtctgagtcagaagtatcagtgatggaaaggatgtgagaatggatcgatgtttaactctgtttagtaataaaataattaatactgggatctatgttaaggtgttgtttgttctgatgatttattagcttcagaacattaattcagttagatcaattaatagcagttgttttacttcctataaaaggaagtaggaacagccaggcgttggtggcacatgcctttttaatcccagcactcgggaggcagaggcagaggatctctgtgagtttgagaccagcctggtctacaagagctagttccaggacagcctccaaagccacagagaaaccctgtctcgaaaaaccaaaaaaaaaaagaagtaggaacgaagaaccctaggaatggattctttgctattgtctctggccctgctgctcttcttgttcagacccagagaggaagggctctttagacaggctgcctagaagatgtttgcttgagacctcacactaaagtgagaaatttgatcataggacttggagatgatggctggcaaggctgacattaaaaaaaaaaaaaaaaattgttttctctctgtgcatctacctgcctgcctgccatgtgtgtggctgtcactagagaccaggagagggagtcagatgccctggagcaggtgttacaggcaattgtgatctgaaatgggtgctgggaactagggttctctggcagagcagaaagtgctcttagccactgagctctccagccccagggctaacttttttttttttttttggtttttcgagacagggtttctctgtgtagctttggagcctatcctggcactcgctctggagaccaggctggcctcgaactcacagagatccacctgcctctgcctcccgagtgctgggattaaaagcgtgcgtcatcaacacccggctccagggctgacttttaaaagcaaaatgattgctaatttcttaattttttcctcgggtggacctgttgcttttacctctccggagcactttccccataagaattgtagataggtagctcattgtcactgattgtttgacaagtccagacatcaagttgcaatgctgttgatagatagttttctgtgtcttagcattggtaacaatctgcctgctgtttaccttgttgttcctagggaaaatgtcctgcactttacagatttgatcacttttttggccttttcagcaaccccatgcattgcatggtgtctcccattctagagatgagaaagctgaaacttggattaaatggactcctggctgccttgggtgttctgaggtggctgaatcacagtggctttggtatctttaatattctcataagatcagaactttgaacactcatatactcataaattataaatctaattggaatggattttttttttttcaagacagggtttctctgtgtaacagccctaattgccctggaacttgctctgtagaccaggctggcttcaaactcaaaaagatcctcctgcctctgcctcctgagtgctgggactaaaggtgtgcaccaccactgtccagcctgggaatggattttttttttaatactcccttcacagtgtgagcacctacaagcaactacagggttttgtggcatccatagcactgtcaaatacataaggtaaatagagcggttcaaacccagggtcttgagcccagggccttgtacatgctaagcaaatgctgtactgttgagccatcaggttgtgatttgatttttatccatccatccgtttatcttgctatctttctagctatctatctctatttatttattaagacagaattacactgtctatcattgggctggcttgaaactgctgtgtagaccatgctagccttgaactcagagatctgcttgcctctgccttctgagtactgggattaaaggcacctccactatgcctggcctaggttgtgatttttagcctgattgtgcagaagaagaaactgtttcagccagtgttcttaatcactgagccatttctccagccccaactgggaccctttttaaaagttggatgaccagtttctaaattaaaagttattagtaacagtcaggtgataatagttgtgcctttagtaccatagatactaaataaatgcagttacaaaatttctcagctagtacgcactaagcagcccttggactgtatctggcatgacagtgggaagtgatcaggcagaggtgttcgcattaaggtttggtcatcgttagtgtgcaaacagtgcttgtgagcacagtcagagcattagagcgctaactgaatgctgtggactcctgaatgacttttaccaggacactggagagcatagcaggcctgaaactcaggcttccctgaaaccgtgaactgtgtccacacttgggatggaaatccctgcactctggaaatgcagagccagcaggctacccaggagtcctcagtgcagctctccccactgccacacactggggtatttgtgatgaaagaagaggcgtttggctggaaacaggctgagtttctagcattagttggtaagtggcgcacgagtctaaagagtttgaaataacggccttgaagttgagaatctgtttgtagagctgctcatctcaaaacactcagcttctctaacaagagccgttattcttagttcagaggtaagaggcagagaggccaggccaacccaggccacacagatcatcccagaaaacgagctagccattcccagagctaggagctgaggctcctggatggcatcccagggtgggctgtttatttctgttagatgatgatggcaaagaaatgaggctgatggttttaagtcctacccagttctgcaaacattttgagcacactgtgaaactgtctgcaagggccatctgggacacagttgttactctatagaggcgtccagctagctctagttcactgccattggtattcagtcacagtgtggcaagagaagggagactttaaactgggagagtcagtgccagggagtatgcatttgtgggggtgtttctgagctgggccttggcagatgaatggggcgcagaagaaacttaaggtagaggttgtggaagccagggtgcagagattagcatatgcatgtggaagatgttgggagggtgaggagagttaggcaggctacagtctgcctcagaaagccctcggtgctaagtcagagagcttgagttgtgttgagatacttaaggaggaactttgtacacccagactttgtgaggaccaacagttatctctgcagcactctgaggactttgttttatccatcattgcctgtgaggacaggataggtagaggaagggaagtcctatcggtcaccactctttctcttgttacaactttgccctggttttccttgtgcccagcatatcctgggcagtagaacaaaggaagaataccacccccacccccacacacactctgagcttgccaaaggtaaactgccttgacccaccctcatctaactagcaggctcaccacttcctggtgtttattgtgtggctctctttcagttgcctgactgattgacccagttcgccatgatctttggaattatttaatctagggctagagagagcacttagtgttcaagataatccaagccagtacccaacacccactttataagctcacagcctcatgtaactccaactccaggggaatctacaacctttggcacctgctcccatgtacaggtacacacacaattaaaattagtaaaaataagccaagcgtgctggtgcatgtctttaagctcagcacttgggaagcagaagtagatagatctctgtgacttcaaggctagtctggtcttcatagcgagttccagggcagccagggtacatagagagaccctgtatcaaagggggtgctgggcatagtaatggatgcctttaattccagcccttggaaagcagaggcaggtgactctcttagttcaagatagtatagcctccagagtgagttccaggacagggctacacggagaaacactcaaacacacaccagagccagggatacacagagaaacactgtccacacacacacacacacacacacacacacacacacacacacacacacacacacacggaggacatggacacgctccagagcacatttgggttggggaaggtttgctggagagatggctcagcagttaagagcactggctactcttccagaggtcttaggttcaattcccagtgcccatatggcagctcacaactatctgtaattccagttccagggaatctgacaccttcatacaggcatacacgaaggcaaaacactggtgcacataaaataaaaataatttattaaaatgcttttgaaattatacattttattttgcgtatattgccttatgtatatatgtaactatgtgcactgtgtgtatatctggtgctcacagaggccaaaagagggtgctggatcccttggaattggtgttacaggtggttgtgagctgccctttagaaattatttaatcttccttttattttttttttatccaagacagagacagttacttcttgaatgacaatgacctgtttctaaaatcatacatttctgtcccgcgcgctgtatgttctcgccggcaagaaatacacgcaggacactcggatcctactgcagacaagctttaatgcatcttgagagcgagagagcataagcttaccagagcggagactctgaaccaagaaacccatcccttaataaaggctggcaagcagccgcctgggacgtgttaccctatgaatggcttcagctcctcaggccaaatgagccacgggataggcagagatcaaaggaatggaaattacccagcgcctgtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattttggacttctttaagattgttacaacagtgagaaaggtcaaaatagctcctagtaaaagcacagaagcctctatattaacctcccaaaatagcaacattcccaagccaaagtccagaaaaaacatacctctccgaatttaccaccctgcagttctgaatccgccccgttagaggggtctccgcggtgccagcgatgttaacaaattcccgggtttcggcaccatatgtcccgcgcgctgtatgttctcgccggcaagaaatacacgcaggacactcggatcctactgcagacaagctttaatgcatcttgagagcgagagagcataagcttaccagagcggagactctgaaccaagaaacccatcccttaataaaggctggcaagcagccgcctgggacgtgttaccctatgaatggcttcagctcctcaggccaaatgagccacgggataggcagagatcaaaggaatggaaattacccagcgcctgtgaagtaatttacattttggtgtcttcaggcaccattattgtaatggagaatgcaggaacggctccctacacatttccaattaagtccagacttttatgtcactcacacaaaaaaaatctgggttcctagccttaccttaaggccttggggtctcaagacagtgcactcaggttctggttgtaatactgtgtattttggggtaagtgccttcttatttttgggccttattttctcagcaataaaaggaagatgggctaaatgagtgctgagactccttcatgctctataattctcagagtcaacaggtgccacattactgtaacctccagagagccaggtgttgctccaagcagtttgcctgtgtaaaaagatgaagtaagtcagccttcattttgttggttgacagcttggtcagtctagggcagccacagctgttttgtagaaggtgctgaggttttttccatttcagttcctagtttagaggctagagctcttttggctgctcccctgatccaatccaggcagtagcacaattcagataggcatttctcctggctcccaagctttctttggatccataacaacctaaccatttggtgaatcaaacacagatttctttttggtctgagcaacctaaggttttactgaggaaaaatctaacagggaccagttaagccccagagatatatcccttgataggattttacttccttgctgaccacctatgaggtcatcaggtgtagaggatttgtctcctgtgtaaggataatggagaaagggaccagttgttaagggttggcctaccttgagtattttgtattaagtgtactctaataatctggtggtgactgagacaccatctctgctgggatgctgggaatgtcaggaagaccagctggcttctctctgaaggcctcagtgttgagtgtaagtcctggccccaccatgagcagctaagcctcttaatatggaaaacactctgcttctaaatgaggacttttaaacctcaagtcccaagttgttcccattctagtggctcactcctttttattgactcccacagaacattgttgtctcctaagaaactttggaaagccagagaactccagagctcattttgtcacataggagggtatcccaggcccaaagaggctagatggcttgttaacagtgacacagctcactgcagacaaaaaggaatggaacccgtggtggaacacgaagaaataaaagacccagagacagatattggggttcaaacttcaagcagaaaagcaaagcagctggcattagcttcttacctctacctcaggctgaatgggctgatcctgtctccatgagctttcaccaagccacagtttgtaacctctcctcagcatggctggagaatgcatgccttctacttaatgtttgatactgacttatatacctttcatgagtcctgggattaaaggtgtgagctataattttcttttagactgtttcaactttgtgtagatctgggtggccttgaacccacagatatccgtctacctcttaatcctgagtcctaggattaaaggtgtgtgcctgacttctatggcttgtggctaactttgttttctgaatcctcaggcaagctttaataaattgtaaataatatatcaccacaccatggtgcctgtctccttgttcagtgacgtctgccttgatgctttctgacagacagactagcactgtggctcaatgttgccaaccctgccaggatggttttgaaaatagctttgcggtgcagaaagccagcatggaagagatgaaatgaacagttgctattttgaggtttgttttctttggagttctaagtggctgtaggtggtttggccagctggcacagcctgggtggaggatctcaaaccccagtggctgctgctgctacatttttactccgtgataaggctaagaagacattagctttcactggttacagtttcctccaatgcaaaggatcagactaattctcccttttcacccacttaggatttaggaggatttagagacccaagaaaaagttggcatagaagtatataggagtttcctttttaatttttaaaaatgatttgcttatttttatttcatgtgcattggtgttttgcctgcatggatgcctgtatgagggtcccagatcccctagaactggacttacaggtggttataagctgccatatgggtggctgggaattgaacccaggtcctctggaagagcagccagtgctcttaaccattgagccatctctccaaccctgactgtgtgtgcgtgtgtgtgtgtgtgtgtgtgtgtgtgtgtgtgtgtgtgtgtgtgtgtgtgtgtgtgtttttaaataaaaatgtatctgaaatgtagctaacttttaccaatatgtacctgtgaaaactcccttccccctttaagctgtctgaagtctccacctttggtagtcttgaccttatagccagccactcaggacttagaggagacagtgtttatctcaacaggtgcttccaaacccttgcagtgcagggtgctaggtattgtagggagatcagaaatgatcagtggctgtctgttgtctctcacttctagcacatcgggttgtgaccatagtccaagggagaaatccaggactgagagcttctagaagagggattactgcttactaggagaggaacgggtttaggatttatatagacatgggtgttgtccttccagtgtttgtaaatactttcagcctcttgcgactggttctccccctacttaaataataataaatactaattttattttgcatgtatgggtattttgcctgcatgtacatctgtgtgccaagtgcaggtagtgcctgtggaggccagaaggagggctttggactcacaggagtctatgctcttaaccactgagctgtttcttcaggttccagctggttctttgcactctagctccctatggagaggagcaggtgctgcctcagagctgtaccttctccctggcaggcacaaaacaagcagtccctctcttcctcttcagcccaggatcccataagctgacctgtgttttcagagtgtacgaccacacatctgagatgattttggcttaagtgtctctgctttcttcggttgcatagtttagaaacaggacacttcctttttcttaagtgaaaacagaatcaagagcaagttttccaatcctttttttttttttttttttttttttaaattttgaagtacagtagaggttttaactgctaacaggacgtatggctctctggtcaatgggagtgaggaaggccatgtccaaattaggttcctggtgacccacttttataaaggttcctaaggtggagtcagtgtggagaggcaacaccctggatgtctgagagttgtaatctcctcactgctcatgtgtagacggtagatagggaagaaggcaacggctcagcctggctcgggttctagtgagtccttgactcttagaaatagaaaccagggattatttgagtttatccccatttacagataagagaaggaaggcttgtggccagagccagatatggagtcatggatggaagagggtggtagcgaggagaagggtggatagtatggcaggagcacctccagtgtttggagccaggaatagccaagggctaaggaggtagggcaggccaggaaggtactgactgtcagctgtctgaggggcaggccaagggagccatagacattctacaccagtctaaagatttcgaatggctggaggattttcatggctaacccttcttatattagttagctctggccgccctaacaggatgctgtgcaccgggtcgcttagcagaaagcagctttcccacagttccgagattggaagttgaagatggagttgggggatggccttcttggcttgttaatggcctctttgtccttacatggcctttccttggccgttgcccatacctgtgtgtgtgttggtggtggtggggtggcatggggaatggggatcttgacagctagccatttctccagcttccctaattacctcttaaaggctccatctccaaatactgacacatcagaggttagggcttcagcctgtgaacggggagacaaaagcagcccatagctgttttttacttctgatgaactactttggtcttttaggggtaggggtgattcctcttgaaggcagcttgttttccttttttctttttttctttgtgtgtgtgtgtgtgtgtgtgtgtgtgtgtgtgtgtgtgtgtgtgtgtgtgtgtgtgtgtgtgtgtgtgtgtgtctatgttttcatgtgtggccatgtgaaggtccacggttctccctttttcattcttgtggcaagtgcttacccattgagccgtcaccctaatacctctccccctttaagtatctttattatgtcctttaatcattttgtttgttttgttttgttttgagacagggtttctctgtgtagctttggaggctgtcctggtactcactctgtagaccaggctggcctcgaactcatagatccacctgcctctctgtcctttaatcttttaacaattatattgtatgtatgtatgtatgtatgtatgtatgtatgtatgtatacaggcacctgccacagtgcatgtttagaggtcaaaggacacatgtaggagttagttctgtcttctgttgtgtgggtcttgtggatggaactcaggtcattagtctttatttactgagctgtctcatctcctacctcttgtttttgagatggtgtttaacagctcaggctggcttgtactcactatataactaaggatgtccttgaacttctgattgtcctgcctctgtaccttctgagactatacccatattgctagggatctgcatcacaacactcaatttatgtgatccagaagctagaacccagtacttcctgtgtgctaaaactgtgccctctaccatctaaactatatcctcagcactcttcttgtttgtcttacctagtctgtctttgccttctgagtgctaagattgtaggggcaacacattgtgctcaattaagaatcctttcttttcctttcctttcctttcctttcttttctttccttctcttttctcttttcttttcttctcttctttctttttgagacagggtttctctgtgtaacagcactggctgttctgaaactcaatttgtagaccaggctggcctcaaactcagaaattcacctgcctatgcatcccaaatgctgggattaaaggtgtgtgccaccactgcctggcaggaatcctgctttctgatcacttcctactctattcttttttttatagtactggtctacaatctagcaccattgtgactttattgaagggagcagtgattattttcatccaatgtttgaatttctgataattctgtgcagtttggagtttgtcctccagttttgttattctcacatatatggcatgttttatctactgtgtttccagggaagatcaggtggtgagctcctgacctgtctgctattgggtttagtgctggagattgaacccggggctttgtgaatacggacccagcactttccagcctcagacttggaatgtagccaacaataaacatgaacttcagatcctcctgtccaccttctaaggactaggattataagcttgtggcaccatatctgatttttgcaatgctgtggatggaactcaaagcctttcaaatgctaggcaaatactcttgatctgagctgcatctctagcctcctgttctgtgttttaattgtgttaaaatatatatgacataaaacacaaaacttgccattttaatgacttgtaaatggctttgtgatattaagtatacttatactgttaaattgctctatatttactgtttttatgtgcattggtgttttgcctgtgtgtgtctgtgtgaggttgtcagatcccctagaactggagttacagacagttgtgacctgccatgtgggtgctgggaattgaacccaggccctctggaagagcagtcagtgctcttaactgctgagccatctctccagtccctgcgtttactcttaagcaaacctgttttttgttttgttttgttttgttttttgagacagggtttctctggctttggaggctgtcctggaactagctcttgtagaccaggctggtctcaaactcacagagatctgcctgcctctgcctcccgagtgctgggactaaaggcgtgcaccaccacctcccggtacaaacctgttcttatgtttagttctttcctgctattaagatgagctgtttctgaaacagatgggatggcagaagggttctggagttagaggaactcagctggaattcaggctccctcacttgctacatgcagttgttttggtttgctgttgagtgttcagtacttcaggcagacttggagcaccctgagggtggccttgattaagagagtctcccgagaaccagaattgcaagcagagcctgctggctttagttagttactctgcagcaaaggagtttattggcccacaggactgtgagaacagtcagggtgcggctgaactctcttctgccagtcacctccattctcttggctccctcctctaaacctagtcatgacagctggcctgtgtagtttatagtttttttcctggaaggaaaattcctcttacctcctttcctctcccattagagttagaaaactcacagaaaaggatcctgatgggctactggagtcatgtgttcatgactagccaatcactacaagccagaggatgtcaagtctgtggataacaggcctgtcccaccctgtgatagggaagcagtctctttgccaaggccagggctttaagggactgtccttaggaaaacagttgtccaccttaccttacctttcctgcttcctgatctggcttattgccctgctcaggtgttttttcccagcccaagcagggcttgtagggaggcaggagacacactccttcactggctgcctatcaggatctgctgaacacgctgcccagggcttgaacacttgctgtgtatagggatcctgagagagtggcacacattctagttaaggctgcacattttagttaagctgcatgcagagtaaagggagacatgcatcaggattccaggactctgaggttctgtgtcctatttttgtatgggccaagaaaggttgccttttctcaaaagagagcctttttttttttttttttttgccatttcccctgctgccgtttggacagggaaatgctgtggctctgcagccctctctctccctgtgactgactgactgactgactgactgactgactgactgactgactgactgactgactcgggaagggcaggctgctttggtctcttgctctacttgactaacagttgcacacactggaagcattttctgctgacattcctctttccccacttccacataaatgtccccaacccccagctctctgttgtcacctcagttgccagggcactcatgcttgctcaggcagaaggggcttttgttggcatggattcagttggaagcagaggaagaaaagccagttggaaaagaaacagtgcaccccagcctgggaacagaaaccaagagcaggcagtttccctctgtctcaggctaagggtgtctagaccagggcctggcatgtaggggaagagcatcatgcttcttcttcctgtggacaggaccagaccacacagctcaacacagagaggtactgaggaaaagtttgcagccttcagtgtagctgccattctctctgcaagaaattggctgtctttttttgcttgtatttttttctgtttagaaagttgtataaatgataacaacttgaaaagtaccttgcttggctacccactcttcccgagattcccaggtataagacccaaaggtgggctttgagatactgacaagcctgtgcgttgtgatatacatacccagatatggtaactgttaggaactgttggatcctgtgctcttagtagttttacttttttattttttaatggatttggatcaagcatgtgacacacactgtagtcctagcagtcagagggcaggaggatcacaaatgccaggccagcctggtcttcatagtaaggctgtgttcaaacagaactaaacaaaacaaaaaattgggggaagtccctggattacatcttcattaaatggatttagaaaatgtggatttaaatgtcagctattgtttgaatttacagaaagacctgaaaatgctttcccccctcaagacccatcttgtcttctctgagtcactggtctgagaaatgttagtcatctcctcacctggctccccattagcaacctgtgatcccctcccctttcctccctgctgtgggttcagacaagtggggtgatacaggcccaggggatcatcctcctggctgggcctcaggttcaagcaagcccttctctccaaacctccagttcaggcctttgaaatccaaacgctccccgttgggtcaccagtgcccactccccacatcagccaagccatccttctgcactgtagtctgtttctgttctgttctgttcttttctgttctgagtcacccagtagcttcccaatgactgggataaagtccagcggcagcgccttaacaaagatgttttttcagctctctcacacctctggggtctcctgcctgagattccagcccctgtctcttcccttcctgtagagtatgtgctaactacctctagaaaaatgtcaagaacaagataaaagtcttgatgtaatagaaagaatttgtttatttcatctgagttgtgtaactcattgacttggagttgttcgtaacagtcccttaccctttaaatagcggtgggatctgtagggaatcccacatttcttactcctgctgtttatcatcttttatttccttgtctagaagttcagtttgttttgtttttcatggcagggtttctctgtgtagccctgcctgccctggaacttgctctgttgctctgtaggccaggctggcctcaaactcacagaggtctgtctgcctctctgcctctctgcctctctgcctctctgcctctctgcctctctgcctctctgcctctctgcctctctgcctctctgcctctctgcctctctgcctctgcctctgcctctgcctcttgagtgctggaatttcatgcgccctttgtatgctttaagttctgtattatttttgagtgctggaatttcatgcgccctttgtatgctttaagttctgtattattttgttgttgctcatcaagacttaaataactgaagtctatacgtggttacctatgtatttgtcctttgtaatgctcttcatctcatacctttatataaatctgtctttcatctggtgccattttccttctgactcaaagagtatgtgtgatgaggaattttttcagtttttctgtacctgatgaactctattttacccttgttttggggaaatttttctgtatttagaattctagggtgacacaattttatggactctcccccccctttttttttttattaagaatctgactctatagcccagactggcctgaaattagaaatcttcctatctcagcttcccaaggactgaggttacaagcatgccccacaatgcatagctgtttctggtactttaatttttttaattaaaattagtgtgtgtgtgtgtgtgtgtgtgtgtgtgtgtgtgtgtgtgtgtatgtgtgtgtgtgtgtattcgcgcacgcgcgcaagtttgtgtttgtgagtgctggtgcccatgtggtacagtgcacaagtgaaggtcagaggacatctcccaggagtatgtcctctcctttccactgtggcttcctgggacacttctgttactttaaagactgctccagtgaactgtgggtggagcccagtggtggagcacttgtctaacatggttgagaccctgcatttagcctccagcagtacaacaaatgaagacgttgttccactggcatctttttgttgttcttaaaacagggtgtcaacaggcagtggcggcacttgggaggcagagacaagtggatctctgtgagttcaaggccagcctgggctttataagaaccagaggctggagagatggctcagcagtcaagaacattttggcagaagacccggctgggttcaattcccagcactcatggcagctcacaactgtctgtgactccagttctaggggacctaatgttctcctctgacctctgcaggctccggcatgcatgtggtatacacacagaggcacacacatacacaagtacataaaaataagacaaataaattagaaatttaaaaaaaccaatctaagaacaaaagtatcttctaattctgacatttgtgttcaagttactttgtgacttgagtatttcttatgttatggttattacctcccccctcttacatgatcagaaacttttggttgaatctcaaatgtaaatttttccttgttgaatgctatattcctgtattttttgttgttgtttttgtctttttgagaccgggttctctgtgtagctttggagcctgtcctggaactagctcttgtagcccaggctggtcttgaactcacagacatccacctgcctctgcctcccaagtgctgggactaaaggcatgcaccaccaccttccggctatatttctgtatttttatagactttttttcttgggaacagtttgtccttttaagatttattagctatggctgacaatggtggtacaggtgactaatgccagtactgaagcagaattgtgagtttgaggccagcctagactctatgttgcgtgtggacttattttaaaaatccccacagtgggtatatgtatagttgtaatcccagcaggaggatgacctggagttcaaggctacttgagaacctcttaaacttaagaaaaatggctagggttggaggtatagcctggtgctagaacatgtatttctctatgagttattgggttcagttaccagcacaggagggagcaaaaagcaaagaaagagatggccttggtgcaggggagccatgctaaagaacctctgagcaggggaggaacttagaagttaaggagatggctggaggggtcttgactgcagttcttcccgagtgacatttgtggccagcattaaacctgggcactgacttcctctgcccagctggagtagctgagttcagaggccagcagaagtctctgatctgtctgacacaggttgtgaaaccagtcaagacgagagaggctgctaatgccccacacagaataactgtgattatgtgacatactcaggaagtgacatgtggggggggtttaattacatttcaggatgatacacgtccatcaggagagttttacctttgtgtttttgttagtctgttagtggaaatctcaaaattctatgagctcctatattttttaagttggaggaagactaagggaaaatatgttccccactcccatgcttttcctggggaggccaaggccatgaagatgtgaggggctcttacttgtgacataatttggtgatgacatagctggagctagattccatatacagaaccatggggtgtgtattgcaggtgctgtcaggacccaagtatctctcagagagtagagagtgctgtccattcagaacaccacacttaagattcttgtctgttatctttaatgctgtgacctcaagcaaggtattgagcttgttttcagttggatatagcttaactgcctgaaggcaagctgttataccaagataattctttttggtttcccccagaggtaagctgaatgtccaacactgtcaagtagcagatgggccgtcgtaggctctatggtgacctgaaaagtacactatgcctcttttaaagctggacatggatagtgcacacctgtaatctcagtgtgtaaaggctgtaaggcaaggaggaccaagaatttaaagccggccagggttacatagtgaggccaggtcttaaagcgagagatagatagatagatagatagatagatagatagatagatagataaatagatagatcaatcaatcaaagggatgctggctgctgcttagctccagcaggttggtgctgcagagtgggccctgtgttgccacatagtcggcatttacagaggaacccccaaatgtggatttgtgggtaaaatatataaataccatatcacccgttaagaccttttgtctgtttatttacctattcatttttctttgtttgtttttgtttttttgaaacagagtttctctgtatggctttggagcctgtcctggaactcactctgtagactaggctggcctcgaactcacagagatctatctgcctgtctctgtccctcaagtgctgggattaaagttgtgtgtcaccatcacctggtttttattttattttttgagatagggtctcatatatatatatatatatatatatatatatatatatatatatgccagactggtttcagtccatggatacagccatttttatgaatttgttttccttccttgacagtggatctcacttttgaagtgcacaccagcttccaactcaaaatcttcctgcctcagcctcatgagtgctgggattacattttaattaagacagaacttatgtgtggactatactggttctcagtttgaactttgagagccatttaagtgggattcagcctggctggtaaacagaaaaagaccttggctttgggtagatcctcaacagcctttcctaaggtccctggcctggcctgagttatcaccgatgctacttcctggttgcttcctgtgtttgtgaattgaaggaatcctagtgggcattgacaaaagtgtgtggacaaatgacagtttgagaaacaatgttgcgataaatctttctgccaaaagccacctgagccccactgccacatgggtggtctacgccagctgcctgcctgagttagggccccaattaatgcacagagagacttgtattaggtctctctgcttggccaatgactaggattctcatctgttagctcagtctccattatcataaacctatatattttataagacttatcttatagaggatgcctttggctggcaccctctcttgccggtggctcacatggcgccgctggaggaggaaggggaaaagggggacacttcctgtttctccttgctaaatatgagtctccttgccatgtcacttcctgcctggatcaccacttctctactacatttcccagaatcctctttgactcctagtcctgtctaacttgctgtcttattggccaaacagtattttattcaataaccaataagataaacataaaaagaagtacattccccatcatctcctcttttctgtctaaataaaaaggataacttatcttttataataactgaagaaaactataactataactatctgtcttcaactctatcaaaaaccacagaaggaaaatatataaactctagaattgacagacacatctcgatacctggacagtcacccaagttcctctgtaacgttggggcatccatcttcagcctataaggccacagtgtgtctggcacacttctccatttcaacaacaaccgttcagtactgtcttgttttgtaagttcagcagtcactttcttgtgggtcctgcatgttccagtttatacagcaacaaacagtccaggcaagagcagtttcttgcccaaatggctaatcttgccttgttgaaagcaaactccataacaagtttcttcgatacccatcctcctttctgacataattggtgtcccaggagcagttgtgtctcactgccaagaaaaaccctaaaccatttaaatgccatatttctgtaggtctttgaaaggtttgaagaatacctatccatctcaaatacatctctgtatatctagaaaacctaactaacctaattataagttctgactatcataggtgactatataacctgtatttaattatgtatatcattttaaaagatctgtataaacacaatatctaaacaagaggagacatatacatatcacaaaattgaccttaaagttgtatcaataaatgaaaatctataccaatgcaaagtattcattcctatatcctaaaacatagaaatctgaccaagtccttgttttcatagtctgaaaggctgtatcgtctcagcttttttggatgtaggatcagttgggtcactgcttcgggggtcttgcttgatcaaaccatattagtctggaaggaatccatagctttttattttctgtggaaacacaaacagaaattctttttccaagtagcctgtccttagacttaaattttgaagtcaaagtatttttaaaatttataagttggattaatttagcagcatttataatcaaatgtattttagcagcagtaagtctttcctcagcaatcaaacaatttaaagacaacaatatggcatatagtatccagattctctgtgtattttccatctttatgtgactttttttattactttatttttactttcttttgtttcttttttcccctgagacagggtttctctgtggaaatcgcctgcctctgcttccttcagcaaatcctactggtgtgtaccaccacaaccggctactctatttcctcctgctatttttttctctcacaagcctacatatatttttaaacgcagtgtaaacctttagaggtttttctttatctggatttgtctttatcatctcagaagtgccgagtccaacgcccaagagcgccgggagggcgtgagcctatggaagcttctctgatgcctctgagcggcccgacagggccggctgtggcggcaggttttcctctttctctgggaaccttggggcagggggtcatcccgctcactgacaccattctgttacgataccgcctgaaccccaccaccacgtgggtggtctacgccagccacccgcctgagttagggccccaattaatgcacagagagacttgtattaggtacaatgctgcttggccaatgactagcattctcatctgttagctcagtctcaatgattataaatctatatattttataaaacttatcttatagaggatgccttttgctggcactgcttttggcggaaagatttatcataacaaaacaaagttcttcccaagagcctttttcccaagcaaaggtcattttcgggccggagataagtctagggaccattaaggggtgagaggacagaagacactgacaggcaaaggtaagatgcagctgagttgggcacctgctgccttcatgctttcacagggttctgctgtgaggagtctaggagccgaggatccgcactcggggaagctatctttcttttccttggcatttgcaaagcacctccttggtagcccggttctgtggggtcactaacctatgtggaaacatgctaacatagtgatttttatcatatatgttttaaaaaccagtttaaaatccactgggaaataattttttgtccagtcagagaatttactgcttgtcatggttgccagctggtagtttctgggcagactgagtcccctgatgcctttggtgccaaactgttagcttgcaaagttggggtgcagaaggcagagcaataggctcaaacggaagtaggccagtgcctgctgctcttcagagagagggtgggccctgcaacaggcagcctgatattgagccttcctgctccttttttaaaaatattacactggggtgtgtgtttgtgtgtgtgtgtgtgtgtgtgtgtgtgtgtgtgtgtgtgtggtgttccaagttgctgagaactgaacccaggatttagcacatgataagactatgctttaccactaacctacattccccgccccagaatctcttgttcacaaattgttaatattcatgcgtgcgcgtgcatgcatgcatgcaagtggacgagtgtgcgtgggcactcacatgccacacacagtgtgctaagagatcataggacaacttgtaggaattggttctccttttaccatgtggagttcagaggttgaactcctttcatcagcttgagagcaagtgtctttacctgttgggtcagctcaccagccaggcgccatcccctaccttcctaactgcctctgacctgggattacaggcctcacctggtttctgtgcttctggggatagaacccagggctttgtgtgcactaggcaccaagctgcatccctgcctctgtgtgacttgggcagatgatgaactctttgcgcctcagtattctaatgtgttaaatcagacaataataatacctacctatggggttgttgggggatggtagatgaccaacaaccctcaaacaaaaaaaaagccagtcataatacccatcatcctgtagagcatgttgtgcaaggcaaggaaagaggcagaggggaaagaagcaagcagaatggagtgaacgcctcaatcatccagtattcctgtgaagattatcttcccttctgcccacgaaggtgctagtaacactctcactttgcatctgacaaaacacactgagagaggtgtaataacttaacctgcctcttgctcagcatcagggccagaattctgtccagtcttgatagtaaaccccattgtaggggtcactctgaccacaccctagcagaatgacccctacctcaccccatgatctcttcctctatgtcctagagctgattggcttcagccaagggttggggatgactaggctggcattggctagagtgataaaatgcttttgtatgcgatacatgtatgagtgtggctgtggctgtgtgttggagtgtgtgcacaggaatgtcgaggccagagatcagtgccaggtgtcttccttagtcatgctctaccttattttttaatgtagagtcctcactaagccgagagcgcactgatccaggaaggctagctagccatgggattacaggtaatctacctggctttttacatggttgctggggtcaggaagcacttgtttttcccaagctggtttattttgttttgtttcaagatagaatttctcgggctggagagatggctcagaggttaagagcactggctgctcttccagaggtcctgagttcaattcccagcaaccacatggtggctcacaaacatctgttacgagatctggtgccctcttctggggtgcagatatacatggaagcagaatgttgtatacataataaatgaataaaatcttaaaaaaaataaaaagataggatttatctgtgtagtcctggctgtcctggaacttgctctgtagaccaggctggcctcaaactcagagattgcctgcctctgtctcccaagtgctgggatcaagtgtatgccactaccacccggctccacaccgtgttttgcagatgttcatgtgtatacgtctgtgtgtacacatgcccactggttgttttgttgctgtttttttgttgtgttttgtttttaaaccttggcactggtgattatattttcctattaaaatcaattctgtccagaagttctgtagttacatagaccagtgacagacattttctgagcacttatttcattcagactctgcatgtcacatacataactcattctgatcagcacaataacctcttgagattggtgttgtcacagtaagggttagtgaggttaggaaattggctcagggcagtaatggtagagctggacttggtagctggccaccgggacttcctaaaccactgttaaaacatgctgtaacccagcagatcctaagttttctggaccatgtaggtgtctcttctagttgttcatagaacacactgtgtgctgtttcagtgcttctgggtggctcagcattctgtgaagttgttattgtggggcttatttctttcatctttgtctgtgttacacagataagaggcttctttttctctagaatcttcctctgcagagagtactgtactgcctgtgtactccctgtgtgtctgctgatgaagtcagcagggtttcagactcccatttcctggtcatacacaagtacttattttaccatctctaaatggagtacattagctccgggccacgtagagcaaattagggagcagggagatagatcacgagaatgaggctgcttggaaaatgtgtctgtgcttctggcctgaactccctagctgtgtgggaataaatacagtgatgttggggtatcatttcaaggctgttgcagaatgagactggctggtctacaggtgatcctgaaacaaagcaacctgtctttataggtgcttttttgcttctgggaactttaaaaaaatgtattacatttattttagagaggtgtgtgtgtgtatgtgtatcagaggacaacttataggaaacaatatctctcctaccatgtggatcctagggatctaacttgatcatcatgcttgctggcaagtgcccttgcctgctcatcatcttatccgtcttactggacctggtttctgaggagtaactaaagcccaagctggtccagctgccttcatacaggataggaaaatgaaaactccaccctgacccagctgtaggcaagatcacagcacctactcagagaaaatacccttgacctgggtcaaccgtcatcccccccccccacctccctcccttccttccttcctctctctctccctccctccctccctccccctcctgttgctcaggatgccttattctgttgctcaggatggatggcctggaattgcagatggagccaccatgcctgacctctttttcttctgactgaggactagaagagcacactgtcatttttcagctctttcatgggtcagcacaagtctcaaacaagatttgcaaagggcagagttgaggactgaagtgaaaggagctgggacatggttccacagttgagaatgccactcttgcagaggacctagagctcagttcccagaacttacatgggtggctcagaccaccataactctagctcaaaggactccaacaccctctcctggctgatagctgctcctgccaacagattggcttctttagtttcatttaactgtgattttgactttgtgtcttgtcttgttctcatacacaggacagatgacagatgagtgcctgtgtctgtcttgttctcatacacaggatggatgacagatgagcgcctgctctgcttccagcacatgatcagtggcttgatgcctagttgtggtcatggttctccagaaatcttcattcacagcagaatgaggcaagagcccttgaaagatggctagaggcaggtgaatcaagccccctcatctgcctttggctcactgcctgctgtggtcctaccatgcatgcccacgccactgagggttcttcatagtcttattaatgctggaggcgcagtgttgcctttttgagggaaatagcctctggagtgtgctggtgtttgctgtgtggtttatgctgattaggaaggaagtgcacacacccctcacccgcaacctgtcatcacttctgatgtttgctttcagttgtaattcatggcttttggaaggactgcagacactgccattcacttctgtgagagctggttcctgccctccttttccatgctggggctctccgtgcccatagggagtgtgcagatatgctttcttcaagtccattgagatgctttgagctattttcacctgtactgaatgtggggcacatcacaacacttagacctctcttcttccaggagaatctagttgatcttggtctacaagaaaggaaatcttccctagttacatccaactgacgcatcctctgttgtcactgtcagatgccttgtagaaggagtttccagtcctgggtgaatgaatgttttccctactagttgctctgcttcttggggtgtctcttgcatgctgtcttttaaatagctgttaggagggtctaatgaagcaactgtctggagaccaatgtttatttcaacatggttgcagttgcttttgcttcagctttcagagccaataaagctggttattagattctgtaattgctgctgtaattactctcttggaactggcaaaggcataattaaatatggagatttcacagactttttctcatctaaaaacaacctcgtaaacttctgttagcagggttaaatttctgctgctaaagccagtgaatttacaaatgacactgagttttgtggctgaagatgaatttctttggatactatttctttgaagatttggctttgatgaacagctgttattagcctggaagctatttctttaatacaaccacccagaatttgggaaggttggcaagtccttacaagctagtttgcatttatttatgtaaatactgggtttgggctctgtggactttggctacttaggaaaacgagtctggttggaaatctggttagagctgggtgtggtggctcatacctataatcctagcacctgggaggctgagtatgctgattgctgagagttcagggccagtctagactacagtaaattccaagcctgcctgaactatagtataggaaaggccttgtctcaaactctccaccccaggtagacatccctgtgggaagaagggagttttacgtggacagtgttcagagggagcatgtcacgtgacccgtgggagcacctgcttcccctaagttatcctcactgtagtgtctcacatctgtatggtgtagggagtgctgtgatacttgtgttcacacacatccttgtggaccagatggcacttttcatggttacaggggtttattttggtgttttgttttgtttcaattttggtttggtgttttgtttggttttggtttttcgagacaggatttctctatagcttgaaccctgtcttagaactcactctgtagaccaggctggccttgaactcacagaaatccacctgtctctgcctcccgaatgctggaattgaaggtgtgcaccaccatggcctgtcagggttactgttgttgtgaaacatattttaggggtttcttagaatgtgttctttctttttagagatgtcaggtagttgaaaaatacaggttaaatatgaggtaagaggaaaaaatatccatagtccctactagacaccagcctggggaatccactgctttctgggatgaaactttataaacccacagcaggagggtgaccctggagaccagggtattttctggggaccttcccctagcttttgcatgtttaccttacagtgatgggcttgcaaaagatgctattgtatgaaccaagaaaaaggcaggagactcctatatagaacatatgctcttctggtcacgctgataagcccattgtaaatggacagtattattaaataaaaaatgcagcacaccttacatagctaccttaagtgctaggatgggaatatttgtgtatgaaaatgcatggagttaaaagattcaacttggcatatattaactaactgcattccagctgacgtgttagatagatattggtctgcaaagatggctagtagccatcattcattcactggagcttgcttccttatttccctggtgtattggcatttgtttccaagtcatttattcttggtgtgtgtgtgtgtgtgtgtgtgtgtgtgtgtgtgtgtgtgtgtgtgtccacttgtccctgtgcctgtctgtctgtccatcccttgtactggggattaaacaggtgctcagccatggagctctgttttttttttttttaagattttatttacttattatgtatacaacattctgcttccatgtatatctgtacaccagaagagggcaccagatctcataacggatggttgtgagccaccatgtggttgctgggaattgaactcaagacctctggaagagcaggcagtgctcttaacctctgagccatctctccagccccagtcctgactcttgtagacaggttctgttctcagttgagccctgggtggtgagagtaggggagtctgagaaagaacactcacgagatgtagggtgtaacgataactctttccgccatctgctcaagccctgctgccacgtgggcgcccaaaatacacagagattaacattaggcacaatgccgctggccaatgactaggattccttacttactacttcagtcttaattatcaatcataattattaatctatatattttacaaagacttatcaaggacacagggtgctgggtctgccctttgagtctaagtcagagcagagtcagggtcttttcaaacttttaatgaggggcagtagtatattgctcttctcatctgtttcggattctcctattccagtggttctcaaaccttcccagtgctgtgatcctttaatacagttccccatgttgtgatcccaaccataaaatcatagctgcaattttactactgttatgaattgtatagtaaatatctgataggagacctcaacagggtcgtgaccctcagatggagaacctttatcttcttcctcaggctgggggagttggattttctataatgttagtggttgaacccaggattgaactatactctcagtcctaaccaatttaaatgttctctttcaaagatctaaatatgctggttatgatggcacactcctttaatctcagcacttgggaagcagaggcaggtggatctctgagtttgaggccagcctcgtctacaaggaaattccagaacagccagggcaacacagaggaatgtcttgaaaaaccgaaagaccgatgcctaggctaatagtcaggtgtcttcaaccttcagacgttgggcacaatgctgtcatctacagactcctcagtggagaagtgtacagttgagttgagttacacaaataactttacagtggttttatgttgggtgttgatagctatcctgtggatcatgtgccctgcaggttgtaggataggcaactgcaagtggaaggacagacagaaaccacctctgtagaggaggttgtcgtgacctgcagctggcatgggtggcactggtgcacacctcctggatgaggacgtgtccatgcatgagtgcatgtatgtgcagcttccctgacccagcccagcccagtccagctgttccttctgcctaagcctgctgggctacctttctgagattgtaaagggaaggagcctacatttgagcgggagctgtatatagtttggtcctagctttgccacagattgatcttattgaaatgcttgccttgactggatctcagacaaaatgatctctctctccccccacaggctgagaactaacagagcaaatgccattgatttgactaaatggttaaactccagatttgttcatggcaggagccgcgtcttcagttgtgtttgtgttttctatgttgtactagccatcattaggcataaagctttctggttttgttcagttgattttcagacagaaattactggctcagagagtgaggagacatctttatgctatgctccattcccactgtacgttcagaaccataacaatttgcagaactgttggctttttgtgacatagcattttaaccaaactgatctaatgcttgtttattatttttgtcatttagttggtgtgaagtggtactgcaatggtgctttataataattagagccagcagggtttttttttttttccggtgtgctagcctctttgctaatacgctaggctactctgtatgttagcacatttcctcctcacagtgaacctagcagggaagctaagccactcacctctgtctgtgagcgaccgtttgaccccagaaagcattcttcctttgggagcctatccatactttgatttttgcaacagatgtggttaccagagaatttaaactgtttgtgtgcttccttcctgtctgcattgtggggtgtgtgaactttggcattttcttagaaaactgaatgtgctcctgggagaagttgctattagctttcttacaaaggaggcagcagcagaggtgcatggagcacatttgggggaagggctcggtgtcctctcaccacacaccgtgccagacatgctcaagtctcccttctccctgcagcggccctgcaggctttgaaacggaagaagcgatatgagaagcagctggcgcagatcgacggcaccctgtcaaccatcgagttccagcgggaggccctggagaacgccaacaccaacacagaggtgctcaagaacatgggctacgctgccaaggccatgaaggctgcccacgacaacatgtgcgtgccgctgctggggggaggactctggagggagggtgctgctgaggccacggcctcattgtggtcggctccctctttgtagcttctgagggaactgtggcctgctgcctttgtttctacgagagctcaggggtggaaagagaaattgtttttcctggttctagattattgtgacaggcttagttccaagttggatagtccttagaagaaggtcttctcagtcaccgatgttcatcagactgtcacagagatggtggcagcctatgctgatcgagggtgggattgggccatagcatgtgtgctttcccccagggctttgagtctgttcttaagtccgctttgggggacctttttgtcccggctgccctctgcttctgttctcagcagtccttccttccctgtggatgcttctatgccagtggcctgagaactacacactcaccttggctccagctgtaaagaacaagggtctttccatgaaaaaaccctgtatttattttagttctttgatgcttcagctggccctgaggggtacttggagcatttgctgctttggccacctatggccttcgatgtatagcagccatgtccttcatttgcatactgtctggagctgctcagtctttataaataacattaaaatatttatcagtgggctggggaaatttgctactctttgctctagagacaagcggtgcggaagcattgcctgacatacatgaggtgtgggagtgcactgtcaggcgaaggctgcatcctttaacatttagaacaacagatagtaagtagtgtgtatgttgtgaagtacacagaccatcttgaatatctgtgtgacacacagtgtttaaaacacaggcatttacctttcctttgggacttcatagatgtttaagtagggaagggcctggctcagttttgtggtttatgattttttgtttggttttgtttttcgagagggtttctctgtattgttttggaggctgtcctggagtggtttgtgatttttaccacctcctgtttagagttgctttggggcttgaagaagacttggtcttggcactagagttaaagtcctgtggtctcaaatctgtttacagatctggggtagaggtggagggtccttgactccacccgatgctaagcctactttccttcagtgctggactaaatgatgtctaaggacttccatcttcgtgattctgtgatttccaattttacatttattttgagtgtgtgtgcccctgcctgtgtggatgtaggggtcagaggacaactttggggagtcagttctttccttccacctttatgtgggttctggggcaaagtactctggtcaccagctcatgattcccagttctgaagggaaggaagaaggcaatgattacaggcagtttcctaaaggagagttactgggtgctaagaagcagagggtatgtgcagggcttctgttcagaccagtcttagctaaagtgataacctgttcatttcatttcaagggacattgataaagtggatgagttaatgcaggacattgctgaccagcaagaacttgcagaggagatttccacagctatttccaaacctgtaggctttggggaagagtttgacgaggtgagtggtttcttgaagatcacatgggtctcataggtgacaagcctcaggctcaacatagtgtgtcaactccagatgtcaacaggcatagtgtgtacctccttggattctgaatttttttttttaatttttaatattattttgtgcttgccatagtggcatgtgcctttaatcccattattcaaaaggcagaagctaacctggtctacatagagttttccaggacagccagtggcagtgagacccagtttcaaaaaagaagaaaaagagaacataattttgattttttgctttaagggtattttgcctgcccatgtatgtctatctgcgcactacttgcatgccttgctcccctggaggccagaaagagggtgtaagcactcacttggcagctagcaactgtctgtaactccaagtccttctgttggggtactgtatgcacatggtgcacagacagagatgtgggcaaagcacccgtatacgtaatataaaatctcagaacaacggcaacaaagaggatggtgctgggttgatggtgcaggcttgtaacccagcagctcaggagtttggagcaggagaacaagcagcctggaccacaggaagtgtaaggctggcttgggcaacagccagaaaccatctcaaaactttaaaaaggaagaaaaagagtctgggtatgtagctccgtggtagagcacttgcctagcatatgcgcggtcctggtccaggtcccagtatttccccctgcaaagacgtgaaaagatacagcccctccacccaagaagctcgtagcagggaccccagatgcatacatatgccagtggcctcctcagaaggttcaccgggcatcaggaggaggaatggctgcagggagggtttcaccacacttccttttgcaggatgagctcttggcagagttggaggaactcgaacaggaggagctagacaagaatttgctggacatcagtgggcccgaaacagttccactaccaaatgtcccctctgtagccctaccatccaaacctggtgagtctgcccacagttgggacacaccctggcaccatgagaagggggtgatcgcatggtcagttgacttcggtttgggttctgagccaaagaggatctgttgtgatgatcacgatgccaatgtcatttgcagaacagatttcgaacctcagcactgctgacatggccagataattccaaggcttgcagtggggctgtcttataggatagccctgacttctctccaccagatgagcagccgctgcctatgatgtcttcaggcattgctctgttctagaatgatttttcttatcccctaataagggaaagttctaggcactgtgcagaggtgtgagaacttaagtcttgctccatccaggactctgtgctatgtgctctctggaatgaaccagctctggctggtttggagacctgctttgtaaaaccatcatttccttgcctgcattttctccctcttctcccacgtgctccacacagagtttctagagagacaaaactgcccatctggagtggagacaagggcctgctagcagggtgtgaacagggtgtgaccctgtccctctgccatggtaaagagaggcccctcaccaatcagtgactaacagaggcagccttgcaaagcatggctccagcgactccaaatggagtcgacttggcaaggattgcatctcttgggagggatggtcttgcttctcccccaaccctgagtgcttcaggagtaagggacccccagtgtaaaacaggccctcctggtatggctgcccctgctgagggctgaggggagttgtggtggaaggtgtgcctggtttcctgaatttgcgtggcagcttgtgggcccaaagagcagtatgctgtaggcctcagctggctgcaggacagggctgtgtgcttacacagcggagcacagccctggcttccaggcacccttcaaaaatcaccttttctgtctccacacagtcaagaagaaggaagaagaagacgacgacatgaaggaattggagaactgggccggatccatgtaactggtccagcataggctggggccagacagactctggtggcctgtgcgacgggcaggcgtgtgcgtgcgcagggcaggcaggacgcggtgcaggcagcctccatcgctcagctctcacccaaagcagtaggccgcatcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgctgtttataatgttgaatttctgtaaaataaactgtatttgcaaatccaacattgagcttctggactacgctaactccactgctgaatcctccatggaaagggtcggccgcttgcagttgaaacgatccggaaatgtagcccgtgtcctttaagtcagctgacttgtcgcacatctctgtaagacgtgtatggtactggcagaaaagtcgtttttttaaaagccatagataggcttttcctcgtccttagctgtaatagcacatctgattttggtttcctcaagagctgtgtttctgtctgtcacctgtgtactgccccccacccctgtgtttaccaccctggcccttgtcactcctgctcccctggtctttggagttgtgccacggatctgaaatggatgtattctcttgagaacaaataagattgttagaattaaatcccagctatccagttttctaacatagctctaaggtcctcattgctgtttgtgatgactgatagataactcactgagaacatgtgcatacatttatattcagatgaaattatggtttgcactgtctattaaatatctcgatttaattttcacacttgctgttgtgttcagtcaatctctcccctcccttgggaaccgaccctctcccgtccagctctggtccagggtcactggggaaacatgaaggacttttgaagagcagcttccttcttcctacaaacttccagcttctggaggccactgagctgtggccactacttaacctggggacctctgggtctatacttagtgagttgattcttgtgcagccccagaatcttccatccttgcctgtcaacacctagggaagtgcctctgggagcctctgcctggtggaaaccacggtgccaccatgatacaaggcccagccaggcagcgtgtttcatagtagggaagtgtattgggtagggactgaggactgagggcacaaatgctcctttggggtctgcccagtctgtttctctttggcccaacacttccattctgcactttattcttgtgccctctttagaaactgatggatgctttggacccttgtatccagctaagtagatctccacatacgtttgtccctcctgcatgtctcaggattgagtagtcacccccatccccctagcttcttttttttgttgggggggagaggttttgagacagggtttctctgtggctttggaggctgtcctagaactagctcttgtagaccaggctggtctcgaactcacagagatccacctgcttctgcctcccaagtgttgggattaaagatgtgtgccaccaacacctggccccccttagcctcttaaggttaaaagcaatctgagttcacagtgggatattgtcatgctggcagtatccccagagcaagctgcctatgttcctgtctttcacactgttctgtttgctgcgaagagacacatggcaacttttaaacgtttgctggggccttgcttacagtttcatagtgggagtccatgaccattgtggcactgtgctggagccgtagctgagagctcacatctttgcaagttgaaagcagagagagactgagcatggcaagggctttggaaacctcagagcccacccccaggggcacacctcctccaaggccacacctcctaatccttcccaaaacagttccaccaactagggaccaagcactcaaacacaggagttgatgggggcccctctcattcaaaccccacagctccctgggtctcatattctcctttgcttgtgggaagctgttcatgccctgctccgtatcccccatgactgctacactcaaaattgggacttgatgatggggttgaaaattcctggcttgggagagatggggcttggctgatgtcacaagttatgtacacctcatgaagaatttagtggtagcactcgctggcatccttctgtttgcttctaggcaccctttggtgtgagattgccggagtggcctgtcttgagtcttaccagctgccttgcactctctccctaggactgagtgagtagagctgccagatccccctcagctctgacaggcaaagagatcaatccaggccagtatcacacaccttgaacctgggactgtggggcacagggctcaccagtgcccagacccttttctgtccttaggaaggtctcagaccttgtgagacataactatgtctcacatagccgttttctttggatacaagcaacagaagactcaaccaacacatagacacgacactcacttattctaaatttattcaggtattttttgatcacctactatgagcaggcactgagaatacatgcaacagagtccatgcccttgtgctgtttgcaggctggtctccgagggacaggacatctcagccgcagtgctggggttctgggtttgaagtggtgctcagcaaccttctcaagagcaaagctcttgctggtgtgatggtacacagctaattccagcaccaaggaggctgatgttggaaggatcacaattcaaggctaacttgtatgtagtagtgagactgtctcaaaatacaaccagccaagatgtggtgtactcaggagacagagacaggagaatccctatgaattcaaggccatcctgatctatataggtagttccaggacagccagggcttcgtagagagacccactctgttgataaacaacaagagttggggagatagttcagtggttaagagcacttgcttcgtgtgctgggcattggtggcactcccagcacttgggaggcagaggcagaaggatctgtgtgagttcgaggccaacctggtatccagagtgagtgccaggataggctccaaagctacacagagaaaccctgtctcgaaaaaccagaggacccaggtttgatccccagcacccacatggcagatcacaactgtctgttactccagttccatacagacatacatgcaagcagaacaccagtacacataaataaaaataaaaatcaacaaaaatgcttcctgctctgcctaggcacatgggccttttccttaggctactactatgtctcctgggccatgactattacatggctgaaaatggaggtttctgttccacccacagctgctgtgctccaaataaacacatggacactgtattaattataaaactgttggccatgggctggagagatggttcagaggttaagggcactggctgctcttccagaggtcttgagttcaattcccagcaaccatatggtggctcacaaccatctgtaatgaaatctggtgccctcttctggtgtgcaggcatacgtggaggcagaatgttgtatatataataaagaaataaaatcttaaaaaaaattgttggccaatggctagggcttcttattggctagctctgtcttaattattaacccataactactaatctatgtatttctacatagccttatcttaccagagagccatgtcctatcttcccagtttctacatggcatccctcctgcaacttccctctgctttccttttcccagccttctcctggtctggtcaccccgcctatgctacctgcctgactattggccaaacagtgttttttgttcatcaaccaataagagaagcatacatgcagaaggacatccccatcagatggctggttccagagtctactaggattccccttaaggctggagatgggctctccggtcccagagtgttttaccgtctgccccttcagagcctagagaagctggggcaaagtggcgcacatcttttatctcagccctaggaggcagagacaggcagatttctgagttcaaggtcaacctgcctcatctgtgtagacaaaacttggcttctgttaccaggaggaagcagctcattgccaagcaggcaaccagaaattcggacaccaaaaatcagccacatggctaatatggatttaaaatgttttaatggttattttatgtgtatgagcgttttgcttacgcgtgtaccaggtgcctgagaagggcaaaggagagtgtcagattcccaagaactgaagttagagaaggttgtgggctacaagtgggtgctgggaatcaaacctgggtcctctggaagagcagccaatgctgccttctcagcccctaaaagcagatggagtcaagacacttttgcaaatctctcaatccctccagattccagttcttaagagccccagaatagctgagtatttaatcttaggaggcagaggtggtgggatctgtcagttggaggccagaccacccttgtctatagggttccaggccaaccagggctacagactgagaacctgtcaaaaacaaaaccccagaacagggtgggggatctgagacttcagtttagcaaagttcttggtaactatcgggacctgtacttaactccagaaggcttaaatcctcaggaaagcatatgtggtcactttgtgacctggctccatgctcatcttccagctactgttacccacaattcctggaatgggagttctagtagcccttgggccttgcctcccactcctggacacagccctcttctctccctctcccctctctcaggtgtgtgtgagtaccttgctcactataagcccaaccctacaaatacatttttttgtttgttttgttttttgagacagggtttcattgtgtagccctggctgtcctggaactcactctgtagatcaggctggcctcgaactcaagagatctgcctgcctctgcctctcaaatactaggatcaaaggcaagcaccaccactgccggcatacaaatgaattttgagtgtctgccctctctaatgaaattctggtttggtaggaaattgaggaaggtagctgccatcactcctttctcatcgcctccaggctctgagtaattgatgtgaaacacatgggaaagaacccaccccctcaggagtgctgatgggaaggagcagagggggaggggagtgaggaggactaggggtggggaaggagaagacaggaaactccaccttgaagcatgagcagggtcaatggctgccccgcttctaagtgatggcagagtcaatagacctgcagtaaatatttatgaatgaattacagatgaggaaactgaggcaccagggtgtttcaaaccttagccagccctaaaacatggtctcagcgcccttcttcccatccagacttcattcaatatgtcttatgtatccatctaacaaaaacagcttccttcctgcctgccaagttgcatcctggccttgctggttcctttctcagcagaagtgtgttctctggctcagagcgccacaggccagaacgattcagttttcagtaggaacagcagctccacggggcatcaaactcagaaaacacagagccatcatttcattcaacctccacagagcatctcagaactatttgcctgttttacagctctgcaagcccaggcacaacagggttaagatttgcctaaggtcatagggcatttcctgtcaccatagtgaggcaggggcagattcacagaggcatgttcctgtttcagaaggtgccaatcctgaatgtgatcaaatgctggggtctaaagatccagaaatgagggctgccactctcatttttgcttcctgctggagccaaaaatcttataagcaacaaaagccagaatcatctagaagacacgaaatggagcaatgggatcagagccatgcaataatagttggtctcctgtgtccttctataatgactgataagatggggaccctaagactgggcccctcctccaacctgagaccttttctcttatccccagacactaatctgtctttcttcctccctctctttaacttggccatttggggacacttggttccttcacagaaagagtggacaaagctaccaaggtgtatgtgtgtgtgttacacacgttaccaagtcatagttgccatggttcatgattcatgtatggaggtcaggacaactttgtgtgttgatcattgccttccatgctgtttgagagagtatttttgttggtccctgttgcatgcaggctagctgacccatgaacttttgggggttctcctatctcagcttcccatctcggtgtagtaccatgcctacttttttaataaaaaaatttatttattatgtatacagtgttctacttgcacatttgcctgcacatcagaagagggaagagggcaccagatctcattacagatggttgtgagccaccatgtggttggtgggaattgaactcatgacctcgggaagagcagccagtgctcttatagcctctgagccatctttccaacccccccccccccgtgtctaccttttatgtgggttctgggggttcaaatccaggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtttgtgtgtgtgtgtgtgtgtgtgtgtgtgtgtgtgtgtgtttgttgtgcctggctctggaacccatggtcttgccatgctaggcaaatattctaccactgagctacactcccagctttttacatagtgttcagtaagttgcaagtatgaattaattcatctggtctctgaacctgtatcaaaagattatttttgaatagctgctatattctgtatttataaattctatatacactgctgtgctagattgtatagcaatatacatgtaactgcctgaagtttttaaaaggcagacacataagaaacacgtataataaagacttgtagcactcttcctacactccaaaggaataaaaggatttacctctaaagtctgcccccccccagtcatttcttttctccatggaaacttctgcacttgcctccctttgtcttgtcttcctgctgttcaccttgtccaccacgctcaaacatggtggcttttacctgtaatcccagcacttgggaggaagatgcctggggattgtaattttcaggccagcacggataactcaacaagatcttctcttttaaaagagaaaaaagagcggggcagtggtggtgcacacctttaatcctagcactcaggaggcagaggcaggtggatctcagtgagtttgaggccagcctgatctacagcctgaggtccatgacaggttccaaagttacagagaaaccatttctcggtgtgtgtgtgtgtgtgtgtgtgtgtgtgtgtgtgtgtgtgtgtgtgtgattttccccctaaaacatcggttctcaaccttcctaaagcttcaaccctttaatacagtttgtcatgttgtgagatggatgatcccaaccataaaatcatttttattgctatttcgtaactgaaattttgatactgtaatgaattgttatgtaaatatctgtgttctgcgatggtcttaggcgacccctgtgaaagggtcgtttgacacccccccccaaggggttgcgactttgggttgaaaacagctgctctaaaacttccctggaagacacagtttccaggtttcagacagaatctgcctctctctgtctctgtctcttgtttctctttgtctctgtctcttctcctcttacacacacacacacacacacacacttcccaaggccttgttcaaggttaagtcagactcagggctaagcacctccaaggaatatttccaaacttctggatccgcagaccttttgggagtcgctgggaccgagctgtgtgacatggaacagaaaggaagcaggctactccgaggagcagcgtcgggcgtgagggcagcagcgctctaggcggcctgcaggtggcgccatctcccagacagtgaagcaactctgggctcctcccgtgctgaccacagatctctgggtgcgagggccaataggagccggcctcctctcctcgcaccccctagccatgcttcttctgatctcaccctcacaccgtcaccgttgcctgctgtcgcagagatgtccccaacagaggttgatggataagaggaccgcacaggggcgggcaggccattgcaacagtagtaatggtgatcacaatactttccctggctcattttgcaggggtcctccgtggaggcctgggggaggggccgctgaggctacctagaaagttctgccagctacctaatagtgtgagatcctgcctcaaaaaaccaaaacaagcttggttcatgctttgccaggaaactcaggagttcattatcatcctcggatacatagcaagttcaaggtcagcttgggctacatgagacgatgtctcaaaaaaaaaaaaaaaaaaaaaaaaaaaaaaaaaaaaaaaagcaaatcaaacaggggaaacaaaaacgaacaaatgctcacagagaaggactgggatttatctcagtaaagtgcttgcctagcgttaatcaagacttgagttcaagctgtgtaggctcgcgtttaatcccagcacttggaaggcagatctctgtgagttcaaggctagccttgtctacagagagttcagaacagccaggactacatagggaaaccctatcttgaaaaagaaaaaagaaaaagacgtgggttcagtctggtactgcatgaagctgggtttggtggtacacatttataaacccagcacttgggagctggaggcaagaacagacgctcaaggctgtcttcagaatcagcaagtttgagttccaggtctgggatacctaaaaccttgtctcaaaacaatatacaagaaaaaccaaaccaaaacaagagtttaaaggcagtgagtcttaattaaaggtgagtattgcatagcgagggccctgtgtagctgcaaggattgaataactatggcacgtaactggcccagcccaccagcatctttgccagccatgacctccaccccctcctgctgtctgcctgaccctgcacctcggtctccaacagtcagtcaggggagcattgtagcatctagtccaggtcttgtcgcttttccactggacacttgtctttgagagctagggaagagctagggagactgctcattcagaaaagtgtgtgtcatgcatgcctaaagatgaagttcgatccccagcaaccaggtaaaaagtcctgaaacagggcactgaaacaggaagatctttgggctcactcagtcccagatcacacacacacacacacacacacacacacacacacacacacaagccaggactaggcctttcagcttggctcttggctcttctactctgaactttgagaactctccactagtatgtcctctagcctggcttgctcatcactgtagaaactttacattttcttcttcagtgtctatttctcctttcagaccacaagttccatgagagcaacagctgtgatattctcatgccctgtgagtagtcttctactgaactgaactaattaacgaggacagctggacctgggcaggaggctttggtaacagcatcatttagacaaataatatcttcatgacatcaaacagtgtatctgtttagcctgccacagagtcaagggaagggcaggggactgtagctctggctctggattccacacactgcagaactgtgaaaggttgggtgacggttactgttacccaacggtgacagtaaccggtgacggttactgtcatctgaccttagccccactagtgctgggtcaatgatctgctatatgttcctgtaagatagattctcacctcagctatcatgttgctgtaaatccagatggcattcatagctatccccttacccctctgtgtgtgcgtgcccgtgcctacatgtgcagatcattcttggccaccctgggctctggggacagtggccgggctgagtcacacagaggatttggtgtcctgtggagagtttagggctcagtcccatatgtcagacagcttgctatcacactccagttgttatgtgcaactccctttaacggcctctaacctctctttaacaacagccagcatgtactaggccctacctggatgcccagcgtgatgtggagggcattctcaaaagattcttaggggcccttatcatgttcatcattgttcatatgaaaaaatagagtccacgaggaggaatgatcagctcaagatttacagtgtgtggtccagggttcccattcacttgacctgtgcacagtggggcacagaacagctcttaggacaataggggacgcagaaccagtacctgagctgatgctctggcctggtatgtattgcaacagggaacaaccatgtctttcctaggacgcaggatggttaagcaggtcaggctcaggctggcccaagctggagttgcagcagaaagatggcttcctggccttacttcccagccaagccagcagaggacaggcgtcagtgcccatctacctgggttggggtgagtatgtgaggagaaggtagctctgatcctgggtccatctgacaatagagacagagacaaagtcccgtggggactttcctgtccttccctagtggagtccagagcagaccctggtggtgcctgtgctgggcatttctgagctgcaaacaccacctgttgggtcccagcccccacggggtctctgagagttgcttgtcagccaatacccacaggtgcttcctgtgttctagtcctggcttacagccccggcctcaccccactacacctgggaaaacacgagctcttcctccacgagctcttccacctggggtttttccactgtgctgtaagtgtatataaggctgctctctccctggacaacggcagacaaattaagatgcacatagcacgggtggccagacgtctctgcttttaactaaatctccaggctttcgcctgatactcggacttagtcttggcaagacgacacaaccacccactcactcagctcctcattggggagtgactaggtgagtgtggttgggttcaggttctcaccagtctgaggcatcagggtacagtgcaaaggcagttttaggcaggctggaggcatcaggccctttcctgtggagatgaggggctagagctgttttcttaggcctccctagcatcaccacatactggcttaccacagtagtgagtagacacacggcctcacagttcaaactgtcattaaacagagatgtatctctatatggttcaagaaaccttatgtaatctgaagttgaggtggtggtgacctaggttgtgggaagcgggcctcctagggactgtggccactcttggctgtccttggctctagtcccagctctgctgcatactgacatcagtgccattattatcttctcttgtctcttataaagatgcttgtcattggcatcagaggtgacatcccaaatgacgacaccttaaaaccctcaaatctatctgcaaagagcttttatccaggaatgtcacattcacagggtctggtggggacacatgttctggggtatcactcttcacctacccaaggctattacaaaggtgagttcagaggaccccttgaggactgctctggcagcagggacaccctctctgctaactctggaggatacagggcaggcaggccttgggtaaagaggcatgtgtcttgtgcagcaaccctgcacccagcggcctgctctggcaaagcactatcccaaaacatattttactcataaacgggccaattaagaaggcaaatgttttcaaacaggaggatttattggcacagagagtgccatccctctagcacaaggagtgggtgtgtgtgtggagccatctggaggggctatttgtcatttttatttagttacaagttgttggattgttactggcggggttttatgaggtctgagcagggatccctagaggtggggaccacaggctgtgtgcacatgtgtttcagtctgtcagtcatgtacacctaatgtctgagtccatgtgcatgcatgtgtgtccctgtattcctttcttctctgagtgtatacatgtatacctctgtatgaaagagtatgtatgtgtacacaggataatatgttggcctttccatatgttttaatatgcacacatgcatacatatgcccatgtacccatgctgtcacatgcctgcatgcacttttctgtgcctttgcatgtatgtgcctctgtgtttgaaagggtataagtctacagtcgtatgagggcttgcatacatgactagtagatgtgcatgtacacatgtgcacactcttccatgcccagcctggagtatgcttgcatgtcacaccccccgagcacaccgtaccctggcagcagtggacaactcctttatgcccccatccctgtcaccacctctgtgactgtcctttaatctcccttccctgtgtgtccttctcttttgcagtggtttgaatgagaatgaccccataggttcatatatttgaatgctggtagaactgtttgggaaggcttaggaggcgtggccttgttggaggaggtgtgtcactggggccagccttgaaaagcctatggcattcccagttagctttctctgcttcatgattgtggatcgatatgcaaatgaccagctccgagctaatgtgaactgctgctgccatgcccctccccccatgatagccatggactctaatcctctgggaccaagatcccaaaattaaatgcttcctttcataagttgccttggtcatgatgtttgatcacaacaataaagatgtaactacgacatcattttgtctttgtttggaccaggagtccccagtagcaagtctcttgaatgacagaaaagggcctgacctggcctagatttagatcctgtcttggtcttgttttgcctgttacaaggacttgtcttggcaaagaactatgctgtcttgttttgattgaaacaagcaatcgtgtctctctgaggccactctttgttcccagaagctgagtgaggtgtagccatagaaaccccagcatgtgccatggctcctgacacacagcctctgcttgcagggatgatgagtacaggtgcagagcatgtatcctgtcccactggtgaccagccacagatggctactgtggaattttccagcctgtatttcccaaaacaagctcaaagattttgtacaggtcaaattgagtttgtgtagtagggggatcctgggaccacccactgtggcttcccacagccacagttctggcatattgtcaaaaggctacacttcctgtgggtcccaccatcagccctggagactggatttcaagcatcatcttctctccctccgtgagatctagccagccactcagtcctgtttactaggcccccagggtatttctctccagtctttggaactctgtggtggcttactcttgcttccagcttgtggcaaggtccttaaaaactctttgtgtctgtcctgtcacatccaacctcatcaagacctatcccattggtatttaaagctgcagcaaagccgaactacttttactctatctgttgtctcttggcttttcatatgctgctcccatttcaggtaacacctgtccaggcttttccactgcccattactcctcttcatcctttgaagccccaagggaagcacccttgaaagggcagaaactccctattcttaggattttgtaaggttatggtatggagaaggctctcaatcagtgggcacactttctccttgaaccaccagcttcttcagttgctgtggagggcggaccttgggcactcagtggtctgagagattggacagtttgactcaggcaggagcgacctcacagccttccccagcctcggacccagcccacaactctcaaatgacatcagctgcagttcctccagcgtgtggatttttctcaccagaggccatttctcgttaaatcggcattttactgctttccgtgggactgtgttggtcatggagaattctgaattttacagccccctgttgtagagtgtgacattctgggctataaagatataatcagctctcataagagatggtttcttcagcactcaggtggtgggaggttgggtggcggcagcatgattggaacccttaagtatctaaagtgactgttgcaagtcccgggagccacaattcaatcagcctctaaaacatgaaattcaacagagagcggtaaaaagatggcagaggacgaaaatgagaaaagaaaaaacgctcaggctggaattgaattctgacgtcacttgatggaagtgttgaaatgagcagtcacccccaccccctacacacacacacacacacacacacacacacacacacacccacacatatacacaccccacacactctatacacaagctccctatgcacacacccacccacacaccctacacacatccctcccacaccttacacatacacacacacacacacacacacacacaccctacccacacatcctgtatacacacacaccctacacataccccaccacaccctacccacatacaccctacacatacacacaccatacaaacacccacatacccatacatacaccctacacacacaccctacacatacacacaccctacacacacccacatgcacaccgtacacacacacacacacacacacacacacacacacaccatgtgtaccttctccagctctgctgaacagaaccaggattgcttcctgctgttctgaaagaaccactcaaagtttcttctctctctctgtctctctctctgtctgtctctctctctctctctctcttctctctctctccccttcctcaccgccccatccttccttccatgcttcctgagtacccactgtgtgccaggcaccactttagggactggaggtataacactgaacagtcagatgtggtcctgatttttgggggtgggggtgggggtgctggggaacagggtttctctgtgtagccctggctggcctgcaactcactctgtagagcaagctgggcttgaactctcagagaactgccttcctctgcttccctagtgctgggattacaaatgtgtgccaccatgcctgctctccccagtctcagctttcctcactgttaggcaccagagctgcttcctgcattggtccgacaattcatttttcttgtgaccagcatgaagtgtgacaatgaagtagtgactgaggccaagcaaatgcatcatatcccagttttgtttgtttttgtttttcgaggcagggtttctctgtgtaacagtcctggctgtcctggaactcactttgtagaccaggctggcctcgaactcactgagatccgcctgcctctgcctctgatgtgctgggaccaaaggtgtgcacccccagcttcacatcccagttctaaagagcacagtttaattgggcccagacacaccctacaaaatttccaaaccgcagagccacacttcctgctctccaaccactctgctggctgagcttccttccttgaccccatcaacataaaacagcaagagacagtgagaattattgagtcataactccttcgagggagccatttgctatccatctttttggggagggtggtcttcaaagggaccacttacagagatagagatgcctaggaggacaagggggtctcgtgcaatgtgggtagtctgcttaggcagttgcctggcctctgccctctgactggacagaagatatgggcgggcagcagggaagtgtagtcaagcagaccctggaggagactgattgaggccacgtgctggaacaagggatcaggggcatcagtaggggtgtgggaacttagcaatgagtccccagcacaaagtagttgctcattacgtgtgtgtgtgtgtgtgtgtgtgtgtgtgtgtgtgtgtgtgtgtgcacgtacgcgcgcccgcgcatgcttgcttgtgaattttcacatgcatgggagacaggacaactttgggtgtcttccacaggagccaccaagaacatgggaggcagcctctgctgcgtaccgagtaccaggccagcaaggcctaaatcaaggtggagaagacagacctgggaagcaggggccagacttgaacaaggtgacaaaggcagaatttctgggactttgcctcacttaacatggactggtagaggcaggaaggggcaggagcagctgtggttggtgtcagacccagtgagaggtgagacatcagggaacaatctagaagctgcagacccagttgtggtagaatattttttttaaggtgtgtgacttttgtttatgctgcatttgtttaactatgtgaagctgtgattctttgcctgtctaaaacacccgatgctctaataaagagttgaagggctaatagcaaggcaggaacaaggataggcagggctgccaggcagagagaattaaatagaaggagagacaaggaaggtgtaaggagagaacaaggagaggagggtgtcaggggccagtcataaagaaggaaagtaagatgatgcagaagcaagagagataaaagcccagagaggaaagatgggttaatttagggtaagaaaagctgcctagaaataagtcaagctaaggctgggcattcataactaatcagattccctgtgtgatttatttgggagctgggtggcaggcccctcaaaagaccccaaaagagccaaagagtaaaaaacaacctccaacactcagtggtctggagagactgggctgctgaaacagcatggtggtctgggaaggagccaccatggctgtgtcagggggcagaagctctgaagaagtagagcaaggagacacggaagctgttagtggacagaagtcctggaggaatgggactttattttagcttaggccctctgacccgttcattgtcatcataattaaagctatccatgtttacctgaaaataaatagaatttggagctggaaagatggcacaggggaaacttgtgcaaatgtggagacctgaattctctctccagagtccaggtaaaggcagcaggagaaaatgacaccacaaagttgtcctcttacccaacatgtatgacgtggcatttgcagccccctaaataatgataaataaaatggaaatagaattaaacatttaaatctttttttttgtttttttgagacagggtttctctgtgtagctttggagcctatcctggcactcgctctggagaccaggctggcctcgaactcacagagatccacctgcctctgcctctgcctcccgagtgctgggattaaaggcatgtgccaccaatgcctggcccatggcaactcttataaaggaaaaacatttaattgggggctagcttacagtgtcagaggttcagtccattatcatcacggtaggacatggtggcgtgcaggcagataccgtgcttcagaagtagctgagagctctacatcttgcaggcagcaggaagtgatctgagacactgggtggtatcttgagcatatgagacctcaaagcctgactctacagtgacacacttcctcccaacaggaccacacccactccacaagcccataccttctaatagtgccacttcctttaagaacctatttctgggctggagagatggctcagaggtcaagagcaccgactgctcttccagaggtcctgagttcaattcccagcaaccacatggtggctcacagccatccgttatgagatctggttccttcttctggtgtgcagatatacatggaagcagaatgttgtatacataataaataaataaaatcttaaaaaaaaagaacctattttcttccaaaccaccataagtagtcaccctaaagggttgtgcagctgcccctaacttacagaggtgggaactgaggttggggagatgaattgcgttagctgtgaggcagatgtgggactgagatggtcaaatgcacacctgccacgttccaaagcccaggctcttgttcagtttcacagctgagaacaatgaccaagtttgggtgatattagagggtcctgagagggtctagacctcttgttccaatttgcagaagcaggagctggtcccagggctcctggcccagccaggtcatcccagggaggagatgtataaggaagatgtcagcgcaaggggccaagtccgtgctctgcttaccctgagctgcacacagtactcccctttatctcccctccaggctcccacaccccacctggcagctgggagcctaaaactgttgctcagaactggtggccaaacccagccaccagcaaggggctgagctctgcaccgaagaatcatgtccttcatcttgtcccctgcattttacaccaccatgtaaaaatttccattaattcctcagaataaaatgtagtggctgttaattttcaacgcctgggaagtagccagctgaatgccttttttatgcctgaaactattttccactattaggaaagtgtaataaaaagttgcctttccttgattttattttttaattaagtgggaagtcctgggcagccctgctgctggcgctgtggcctgcagcctgcagactaaggaagtagcagagaaaggacacaagccagttcaccttcccaacactgtttccacagccaggccccaaccctcagagccagccagcagcgctggcctggcccagatcataaagaaccctgaatcctttttgtgttccaaggctgtattaggtagtgtgtgtttgagtgagggtgtgtgtacatgtgaaggtcagaggccagccatgggtgtactttctcaagataccatttgtaatggctaaagaaactccagttggtgctaggcatccatctgggtacctgatagccatttgtctctaattcaagttcctggaggtaagttccaggcaaccctgacgccttggcttccacccaggaatgtacagttgtgacatggacagttgttatgacaaaacctggttttggtttctgtaacttatgcagacattcaaggactattcaaggtcagaggtcactttgaccctctaatactggcaaagcagaacagctcttgtggttttcacctttaaaatcccttcctgctcctgcatgacacatctctgatttgtgctagagactgtggccctgctagaagtttttaataaatctggctaattataatctgaattgagtcttgtattccccccctccggtggtctcgaactccataacacactcaacttgctttttgagtcaggtttctcactggcctataacttgctgacttggccaggctggctggtcagagagcctcagggatctcttcattttgtccttccaagtttgggattataaactcatatcaccagggctggagaaatagctccacacttagcacttgctgcttgctctccccgaggactctctttggttcccaagacccacaccaggcaattcacagctgtaactccatatccaagggacccaattgttgtggaatatttaactgtgtaaagatgtgctatatttgtttatgctggggaatattactttatgtgaaagtgtgttacatttgtttctgctaacatttgtttttgttacatttgtttctgttaacaatgaaaagatgtgttatatttgtttgtgttgtatttgtttaattatgaaaagatgaattccatttgtttcatcttgcctgcctaaggcatgtgattgatttaagataaaagctgaatggccagtacctaggcaggagatggataggcagggctgacaggcaaagaaaattaggaggagaaatttcagctggagaaagaaggagaaaagaacaagggagaaagagagggacatgtctggggccagaagccaggtggccaccagccagccagacacgggaagcagtgaaagttacaagtgaaagtaagatacactgagaaaagaaaggtaaaacgccccaggcaaaacttagatgaagagaaacagggtaagttctaagagatagtggggcaagcataaggctgagcattcataactagtaagtctctgggtcatgatttgggagctggttggtggcccaaaagaaagcctgttatattcagtgccctcttctggcttctgtgggtaccctagcccagcatccgcacacaggcacacacagagaataataaaaataaatcagggtggagaacaaacagttaagagcacatactagtcttgcacaggaccccatgtcgtacagctcacaaccacctctaactccagctctagggagatcctatgcttctgacctctgtgtgtggctgctctcccgtgtctgcatacacacacacacacacacacacacacacacacacacacacacagagcttaaaacaataaaaaattaatctttaaaaaatgtcataggtttgctgagtgttgtggcattccaaggagaggctctgagagttccaggacagccaaggctatgtaaagagaccctgtctgtctcaaaaaacaaatcaaaacaaacaaacaaaaaacaccactaccacaacgacaaaaaacaaaacacaaaacctccaaaacaaaaccaaccaaacaaacaaacaaacaaaaaatccacaaaaacaataggaggctggagtgacagctcagcagttaagagctctgactgctcttctggagaatctgggttcaacctccagggagtctcagagccacttgtagctctagtcccagggatccagtgccctcttctggcctctgcaggcactgcacacagttggtacacaggtatacatgcagacaaaatacatataaaaataaaggttaaaaaatattcaaaataaaataatcataaaaaataaatctaaaccgggtgttggtgatgtacctcattaatcccagcactcagttggcagaggcaggcagatctctgagttcaagtccagcctggtctacagagtaaaaccctggctacacagagaaaccctgtctcaaaacaaaacaacaaaaaaccaaataaacagaaaacaaaacaaaaaggcaaaaatgtacgctagaatgagcacctaaacaaaaagacagcagcaacaacaaaaattattttactaactaaatcatctccccagctccagagcctcaaacctttgaacaagttctctctactgggctggagagatggctcagtggttaagagcactagctgttcttccagaggacccaggttcaattcccagcattcacatggcagcttacaactgtctgtaattgcagttccagggtaccgacaccttcatacagatatatatgaaggcataacaccaatgttataataataaagaaagaaagaagttctctctgctctctgggcctcttgattgcctcatctctgagcatcccaggattgttaatcaatgcactgaatgagtaaaggaatatggtgtctggtcctcagtagccatcaggaacaatgaagacaagggatgttagcataaagggggtcttttttttttttttttttgagacagggtttctctgtgtagctttggagcctatcctggcacttgctctggagaccaggctggcctcgaattcacagagatccgactgcttctgcctcccgggtgctgggataaaaggcgtgcgccaccaatgcctggccataaaggggttctttaagctagtctggggtgacaagcagacagaagggatgtgccaggtgaaggctgaactggatgagatttaccggaccttgtcatggaaagaggacagaagagcagagtctgatggccgtcagtcacagtgcccagtgaccatttgtggatgaggttagtgtcaatagttggtgacactaaaggaggacacccttggtgatatgggatcactctttcctactgagcctgactcatacatggaaggaagatggaaggcaggggactctggtggtctgtgtccctgcgttcttgttctgatgaatttctgtgtggtgggcatgtccagtgagtgcccttgggtcatgtgggccatatcacccaggtggagattttatttgccaagggtttcatccagcgtctaccagggaagacactccccactaactagagtgtccacctagagggggatctcagagttcagggcttctggcttcttcctgttcccttacctctgcctccagtctgggaccctggtcagctatctctttcataaaggggatcggctattcttgtcaggacatgcacgtttcaaggtttatgaaagtcacatctgtgccagtgtgaccttgtttcctggaaatccccaggccacggtgcagcacaccattaagtgacacaaagtgttagccctgctatcattaacctcacatctttgacacaaaccactgtcacagccctgctgcctcagagctcaccctccactctttcccctctttccaatgtgctgtatgactctaggtttctacagtcaaacccaaggagctgaagacggagctgagtggtagatggtaaagctgtggcctccatttgctcatgtgcctgcccttcgagggctcctagctatgttggaagaaactccctttatttttctagaatggcaacactcatctctgaatgtctctgctattatttttattgatctctctaggtttctttatggccagaaataaggaatccaatttgattagggactgatttggcctccaaggtaagaagcatcaatacaacagctgagaatcaagcagatgccaatttggttagagttgattagacgcatttagggtggtaccatggcccacccatgcctttcaaccatcccttccagctgtcagctgccccgtcccttccctgctgactcccagtggggactagtaaaaagagaaacacaaggttctgccaagtttgggagcaatttacctgtggtgtcaacccagacactcccatcctctaggggggtgtgaagagatgtttatatgctaattttggagtcataccaacttgagttcaggtctttccacaaagcccccaggaaaggtcatttaccttctaagcctctattccctcatctgttaaattcgtaaaattatttggaaaccctaggggctggggaatccacctcagttggtagaatgcttatctagctcactttaacccaaataccaactctgagcctttaatcccaggtaggcagaggcaggcagatctctgagttccaagccagcctggtctacagagtgaggtccaggacagccagggccacacaaataaaccctgtctggaaccctcactgcctcccatacagagtcacctctgccttccagagccctgaaaccaatgtcccgtgtcttccaacagcctgctgcttcctttgtggctcaactatttcatagagtcccacagccctaattctacaaaacaacaatggacagaaactgacttagaactaccagtgtctaccattttacagctcactcatcactgttaaaaaaaaaatgttgccatttttaaaattgttaattggttattgattaaccaatgagtttgctggctggctttggtcaggtgatcatttctagccttacatctctggtctcattcccacctcaacactttggctgcaacctcgtgtacttcttacctgatctcctgatccatgctacagaggggctgggcaggggctgtcagccccatccacccaggtttgattcattttggcccagggaacaatggttggtggatgcagctcaggcaacagaggagatgtctactattcatcccttgtttaattttaaagacttttgtaaagctctctctctctctctctctctctctttctctctctctctctctttctgtgtgtgtgtgtgtgtgtgtgtgtaccaagcaggcaaggtcttgttttgtattcttagctggcctggaacgtactatgtagaccgagatagccttgaatgcacagagttctgactgtactgcccctcctcttgaatgctgggattaagggcatttaccaacactctggaattattttttatttttaattatgtgtatttgtatgagggtgtggcatgtgccttgaagtacctgtgggggtcagaggaaggcaccagatctcctggagctggagttacaatcacttgtgagcagccagactgtgggtgctggagaccaaactccagtcctttggaagagctgcaagcactgctgttcccatcattcattccttttggatgtctgtctaggaatggagctgttagatggtaaggcaggtgcacactcgtcacctatatattcttttacctctttatactattgttgttcaaggctagcctctgagctcaacttctaccatcttcaggcctgctcaaaaagatcctcacaactaggcctgttgactgcttatctcccccagatggtgggagtatccacccatcccttataattcatcctaatgtcacatgtcttcaggcaggggctagaggatttacttgaaaaaggatgagcggaggggggttgatccctactgtgtgctgacctccaagaatggctactctaaggtcacctatgctcctacacataactcctcacacagtgctctgtaaataaggctagtgacatcattggttctcccagggtgggattgaagcttagtttatacttgggaccttctgagaaaggtagacattgtttttctctccctagtgaaggcattttagtaacaagtgtttttctctctccctagactctaagttctccaaaggtaggaacaaacctgttgttcacagttatactccctgcatattcatagcatattacctggaacatagtaggtgctcaataagtattttttgaggggtgggaatgtaattcagtggtagaccacttgctctgtgtgcacaatacactgggttccatcccaagtgtgtgtgtgtgtgtgtgtgtgtgtgtgtgtgtgtgtgtgtgtgtgtgtgtgtgttggagcacattgaaaaaaaaaatgcaagaacaaacccaagctgctttcagttcaaagagagttgtgacaactccaggacaagacccaggacctcccacagcccccctgccctatctactgagacaaaagcccagctgactcataaagagccagcagttcaagggctgcttgatttcagcatccccttgttctttgaagaaagagcatccccctctccctctcttggtctgcattgtcacagcttgaaatattcttttgattatgagaacatttcccattaagtgtgtgattccagctcctccccacccccaccccccagtatttatgaccccataactccagggtctgtcacaactggttctgcaaaagtgtatctgagtgtaatgaaataattccatgaaaatcatggtgagaggctgtcgggttcccccgccttatgagcaagccatcaggggatggggtatataaatcacagcctcccttaattaagtaaaacattttaaggaaaaaaaaccaaattaattaccacttcatggcaccaccccagcagattacgcaaatggttcacattccataaaccctgactgaatttagaactaattgttgctctttgggtttgtttatgctttcccacacactgaagatctgtttccaaagtggtagttcgggaaggctcctccatccaaaatgatgtaagttgtcataaaatcaagaatcatggttttctttttcttttttttttttaaattgttgttgtgttatgcaagctgaaaacacaggctgtgtgagcatgtaattgaagtatccacacctttggtgtggggccttggcttggccaagttcctgagtgctgtgtgagtttgaacaggaaccgggtgtctctgttcttttccagtcactggtaatgcacaggtcactatgcaggcagcctctgggctgctccaacaggaggtgatggtcacctctcaacttcctacagtctaatcctgatggcccgttttttttttttttttttttttttttttttttttttttttttaatgagttagggattgaactcagggcttcctgaattctggacaagccctctgctgcatgcccagccctatagcaatcattcttgaactctttttttcaagctaaattttaaaaatagatggctctagtgactcctggatgttggtatctagtttggcagtgtggtgttctaagaagtagccaaatgccaagatatctgagtgtaatactgtcattgagttttcacaaaaaattagggataatttagctctccagtggggtttcagccagagcagggatgagtctcaataggaagggtctggccacattccttcctgaggacccttcagggcctagaatgctgcttaattccacctcctgggtttcaggaggctgagtgctttctaaggatcagtggccatttgtttctgtttggctcctgcccggactctctctagagttcaaggctgaggcaagagcctatgagctgctccctccaagttatctgagaggttggggtggtggctattcttggttgccaacttgattacatctggaattaacaaaactcaagcagctgggtacacctgtgagggatttttttttttttcttttgtgggggagcttgaggcagggtttctctgtgtagctctggctgttctagaaatcactgtgtagaccaggctggcttccaactcagagatctgtctgcctctgtttccagagtgctgggattaaaggcgtgcaccaccaccaaacagcaggattattttcttaattaaataatttgaagtgggaggatccattcttttcttttctttctttttttttcttttctttttttttttgcttgtttgtgttttgtgttttgagacagggtttcactgtgtaacagcgtggctgtcctggaactcactgtggagaccaggctggccttgaactctgcctcccgagtgctaggattaaatgtgttcatcagcaccaactgtctgggaagacccacttctaatctggatcttttgaggttgattcacctttagtctgggccacaccttctgctggcatcttatataaaggacatggaaaaaggaaacttgctctctttgccagcttcttctcactggcaagtccattccttcactggcatgagagcctgcttctttggaattctgatgtatactaaagtccatctgagacatccagccttgtggacagaacaactactggattcttagaccttctgttggtagacagctgtcttagtgtttctattgctgtgaagacacaccacaaccaaggcaactttttttttaaagattttatttattattatgtatacaacattctgcttccatgtatatctgcacaccagaagaggacaccagatctcataacggatggttgtgagccaccatgtggttgctgggaattgaactcaggacctctggaagagcagtcagtgctcttaacctctgagtcatctctccagcccccaaggcaactcttataaagaaaaacatttaattggggctggcttacagtttcagaggtttggttcattatcatcatagggggacatggtggcatgcaggcagacatgctgctggagaaggagttttacatcttgatccgcaggcagcagaaggagagatggagtactgggcatagcttgagcatatatgagatctcaaagcccacccatgtagtgacatacttcctccaacaaggccacatctactccaaaagaccacacctcttcatagtgccactccctatgggttaagcattcaaacatatgaatctatgggggccatatctattcaaaccaccacaacagccattgttagaccggctggaccacagcctataagccattctgataaatcccgtgtgtgtgtgtgtgtgtgtgtgtgtgtgtgtgtgtgtgtgtgtgtatgtgtattcattaattctgctcctctagagaagcctgactaatagaggaggagtggtctggataccatctttgggatgtcagcaagtaaagtgagtacctagcatgagactatccatttgaaatatatctctgtatatttagaaaacctaagtaatataagtcttgactattataggtgactatctataatctttatttatttatacattaaaatttaagtaagctgtataaacacaatacctaaacaaaaatagaaatataacaaaattgaccttaaacttgtatcaataaaccaaaacctataccaacgcaaagtattcatttctatatcatattccctttttttcctctagaaagtgattgacttgtgatcattgaccatttataaccaactccgtttaaatgaaaacaaacatttataaataataattaggaatttggccatagttctcttcaaattgtttcctgctgttttggggggttgtcaatccccaggggatcctgagaaatcccagaaccatggccaaatcctgtctgaaatagtctgtgagactacatcttctcagctgttttgaatgttggatcaccagggccattgcttcaggggatcttgtttagaagggatccaagcttcttatcttctgtggaaacaaaagcagaactttttttccaaagtaacatgtctttagtaacatgtcttaaattttgaagtcaaggtgttttcaaaatatataggttggattaacccagcagcattgataatcaaatgtctttcagcagctattgttccttcctcagcagtcaaacaattcaaagccaacacaatagcatacagtatccagactctccgtgtattttccatctttatatgactttttattactcaatttctttcattttcatttatttatttgcttgttttgagacagggtttctctgtgaaacagtcctggctgtcctggaactcactctgtagaccaaactagtcttgaaatcatagtgatccacctgcctctgccttctgagtgctgggattaaaggtgtgtaccaccatgcccagctattataattctttcttaaggactttctctatcctttttcttttctctcccaagactatgtatatttttaaacacactgtaaaccgtttagagggttttttcctctggatctgttgttactgaatatctctatttttttttttttttgaccacatgagtctttattctactaaactgcaaactgcccagctagcacagttggtagagcatgagactcttaatctcagggttgtgagtttaagccccacgttgggtgccacatgtaggcagaggtttctgtcccgcctggtcccacaactatttaatcacaaataaacacatggaggcttttttttgttttttggtgttttgagacagggtttctctgtggctttggaggctgtcctggaactagcttttgtagaccaggctcgtctccaactcacagagatctgcttgcctctgcctccagagagctgggattaaaggcatgtgccaccagcgcccggccacacggaggcttatattgattataaactgtttggctgatgactcaggcttctcattggctatctcttaattattaacccatttctattaatctgtgtatctccacatggtcttggcttaccggtgattcctgggtcttttgcttcctcagcagctacctggtgtctccctgactctgcctactacctttctctatccctgtttggatttcctgcctggttaaattctgcctgtgaattggccaaaagcagctttattcatcaaccaataagaagaaaaacatatatccacagtacacagaaagacacccccatcattgaggactgagcaggaccaagtaccaatggcctgaacttcaattttagctctgtccataacactgcaaccttagactgatgtcattctcttgccttaattttctctgtacagtgaaagtagcttttttggagactgagatggatctatacattaatgtttatggcataaagtgaggactcattgtctccatcaccactgtcatcactgccatcatccataatacacagagaaactgaggaccagaaagggtacaggatgacccagagttacacagtaagccatagtggtacagggaccagaaggacagctgtgttacccacttgcatagctggctggcatcctgcccaatgttgcagttacaggatgaggaacagagcaggacagatgatctggggcatttgcctcctgtccctgtaactctcctctgtctctgttcatctttttaggggtccagtcaggacctctttccttttttggaaagacactcctggattcctgatgttaggatatatatctcctcaccattttcaaatgtcacctgttctttcttgtaccctagatacttgccatatctgaagccacctggatgattgtgacaccccccccccacacacacacactgctgcttggcccctctactctctggggaaattgttctaaagcacagatctctacttaaacccaccaaggtgtaactggatcaggaaaatgttatatgcatagaatggaacattatccaagctttaaaagggaaagctggggcagagagacagctcagtgggtaaaggtgctttcattaagtccagtgacctgagttcagtcctgactcttacatggtggaaggaaaatgactctcacaagttgtcctctgaccgccacatgtgcatcatggtacatgcactcatggatccttagagagagagagagggagagaggaagagagagagagagagagagagagagcttgcttcactggacaattttgaggattacatgttactgcttgcataaaaagtattaccctcatgcactggagtccgtatccccacttggtagtggttttatttgtttgtttgttttgtgagcaagttctcactatgtcactctgactaacctggaactcattatgtagaccaggctaaccttgaactctcggagatttgcctgcctgtgcttttttgagaggtttagagattttaggaggttgcaggtcaccaggggtgtgtttggtcctgggtccctgcctctctttcagcttccagtccaccataatgtaaagaaactccttttccaagaaccagatcacacacactctccccaaagccttcccttagtccctgtcctcctgggagcacgatgccagagcatgtacccctgtgcccccaccacttccttccggatagcttaatggggttcactatgtgcagatgagtgtgccaaacaaactccagtcaccgggatcttgatgaatcaccatgatggtcctgcaccgtctgcatttcgcaaatgtggaatcgaggctcagaacaggagtatatcacataactagtaagttgtgtccccaagacttaaacattctgaattccagagaaaaacttctgacaacttgttacagtcagctttctgtgactataacaaatgccttagatgaatcaacccagaaaaaggaaggtttgttctgcttcacagttgtagaggtttcaatcaatgataaactggccccattgttttgggctgtggtggtacagtccatcacaacaagaatgtgtggcacagggggtcattcacttatctcacagtagactataaagagaggaaaaagtcagagttccattatcccctttaagtgcatgcccccatgtccccagtggctccaaatgtcccactagaaccaccccttaaacatttcatcacttcctaccttggaatttaacaaattaatctttgagggacatatatccaaatcagaggaccatttgattctgttccccaacaccccctggaccatcacaccacctatctatcatttctcttcactcccctccagtcccagtgaggggagggctgtggtttagccatcccagagcttggcacagagcaggtgctcattttgctgacttttgtctgctgccctgcagtgagccactatacacacgcaatgctctaattctgcttccgcaactatttcccctccaggaattggcaggttggcaattgccaaagaaacatcttcagccaatcaataaataataatgttggagaatttaaaataagaatctggattattaaagttacaaatctttggtctttatgccttcaataaaacatgcatctattaataatgaatactggctcgggcctgcttaggctgaaaaggggaggaaaaaaatgaccagtcaaaagatgctaatattttttctttttacccagcttggttgccaagccactgcttccatgacaaattgttcgccatttgaaaggtttaaaagttttaacagcacaaaagggaaattggagaccaaatgtttagccttgtgaaccttcatggtctttcttaagtttttccgctccatggactcgtgctccctggtttctctcttagaccccagtagccccttctcttgtttactctttttttccctccagctttcctctttcctctcctcacctcccacctgacctcatccactcctagtattgaagagtctaggttccatccccagcactgtgtggtggtcacaaacctgtaaggccagcacttgggaggtggaggcagaggaccagaacttaacgtcgtcctcaactaactagtggtgagttcaaagccaccctgggctacatgagaatcaatcagtcccaatctctgtctctctctgtctctctctgtctctgtctctgtctctcctctccccttctgtgtgtgtgtgtgtgtgtgtgtgtgtgtgtgtgtgtgtgtgtgtgtgtggtgtgcctctctttctgtgtgtgtggtgtgtatgtgtgtgtggtgtgtgtggtgtgtgtggtgtgtgtgtgtctctctgtgtgtgtgtggtgtgtgtgtgagttgtgtgtgtgtgtgggtgtctctgtgtgtgtgtgtgtgtgtctctttctgtgtgtatgtggtgtgtgtgtgagtgtgtgtgtgtggggtatctgtgtgtgtgtgtggtgtctctgtgtgtgtgtgtgtctctctctctttctgtgtgtgtggtgtctctctctctttttctgtgtatgtgtgtgtgtgtgtgtgtgtgtgtctttctgtgagtgtgtgtgtgtgtgtgggtgtgtgtgtgtgtgtgtgctcgcacatgctgggagatagctaagttggtaaagtgcctacatcacgagcatgaggatttgagttcagatgcccagcactcatgtgctggtttggtcatgcacagctgtaatcctagcattgaggggtagagacaggaagattttcagaatcggtctaaccagtcaggaagtgcttggttcagtgagagagcttgtcttagagagacggtggagagggatctgatattggcctctcacctccacatgcacgtgtataatgtgccttcaccggtatatacacagtcacacacacacacacacagtcacacacacagagtcatacacacacagagtcacacacacagagtcacacacacacagtcacacacacacaggccgttacacagtcacacatacatacacacacaggcacacagtcacacacacacacacacacaggcacacatacacacacacacagtcacacagtcacacacacacacacacagtcacacacacacagtctcacacacacagagtcacacacacacagtcacacacacacacacagttacacagtcacacatacatacacacacagtcacacagtcacacacacacatgaaggaaaaagaatggagggtgcaggacttgcattgttaggacctgaaggcatatgtgtgttagcaaggcagaaactttctgctgtcattagttcccatctcttggtaagtcacatacagtttatgtgccttctggtttgttgatgttctagtaggacaacacttaaccacagtagcaccacactaagtggttggccagtgtgattcatcggaagggactgtgagtgaagacagacaaatggtttcttctcactttacagtatttcagcacagccacttgaccttcttcctttatgcccatcattttggacgtgagtccttccttagcagcaccacaaagtctacatgagatgaagggggtttcattctgaatgtagcaatcaaagcatgtcactttctagtgacttgccagtgacatccatttgcagaccattctgaaaatctttacgtgtcttttttctttttaaaaatctctgtgtgttgtctgtgagtatgtgtgagtgcaggcttgtaccgtgctccgtgagtggaggtcagggcatcttgggtgccagtccttgccccccaccttactagagacagtctcctgctgtgcttgctggcttgcctgcttctggagtttctccacttcccagatcccagcgggagtgctggagattcaaactctggtcctcacacttgaagggcaacccttcacacactgagccatttccccagccccaaccttcacactttctgtagtaaccaaagactccatctgcagcatgatgacaatcattttttttccctgtaaattgttttgtgatttggaaaggccttttattttttgttgagacaggatcttgcattgtaacttaagctggcctcaaactcactatgcaggacagtctagctttaaatatgtaatcctcctgcctcagcttcttgagttcttggattacagctgtgtggcatcgtgcctgactcaaaacacagtcaaaatgctgtggagcctggtaagaggcctctcagacatgagggtatgtatttgaacgaagctataaaaccctatcccttcctccttgtcaagtctacttctagaagttcttctacagctagaaatgccatagtctgatgagagatgctggcatcgaagagctgaccctgcctggagaaccagggaacaaggtgaaagtgccatggagcttgctgggccttaagaagaggaataggggaaaagagaacaaatgccggtttccacatgggaagcggcaggtactcgttctagcatacattttcacttttaaaattgtctctttttttttgttttatcttcctctttcccacacctctacattcacaaacacactgaataaccattaggattcttgcttgcaagtgacagaaaactcgccttcatgaggctgaaagcataggagtgccagcgtttgagtcattaaaatgtctgaaacctcactcaaacgttcagacccagggacggaacaatggtgccataacacggcctttctccgagactaaggtcttagcctgctcactccatgggacagaggaggctgctgtcagcaccaggtctgccatctcaatgcagttaatggatttcgttagagttgcagtcggattctttgtaaagcatccagtcagacaactacgaggaagcagttctcttgcagaaagtagggcagataaatgggccgttagccacagaaactgcacatgtctgtttccatggagtagatgccaggaagatgtaagctttgaggattgaagagcccccaggaaggatagaacttgagccccaagacgcaagatggggaaggcctgagaaacacagagctcagaagtcacccagcccttttactaggcaaatgaagtcatgtagaccagaaaagggccctgtccagggtcacaactaactgaatcagagtttagattcgaacacaggtgatgtgaaggccagaaccaagctctgtggacctggcagctgccacattcattagctccctcctatctgcttgtttcccagtatatttttacaaggctgttaattactagccataaagctcggcaaacattttgataggctttaaaagctcatgaaaaccacattacattttaaggcatggttccctaattaacccaattagctgtcagactcatatcctgctggtttccagatgaggcgagccctgcctctcatcccccaatccagccccattggacagggcctggagtgttcctgtcaagatctctctgcagtacaaagacactggcttagagatgcccgtgcaaacaagtggtgcctggccagcttagcttaggaccaaggctaaggtataggcacatgggggcttccccagtgatgctgccatccctgtcctcattcatagccttggccattttgtcatgcttccctcaacagctgatagacacagacggacacctgaccccaaatagctcagttctgaaccatgacatagctcaaagacatgggccaacttgaggcaactcaggagggagacaagggaagcaggtgtgatgtattaatttcttagggctgccatcacaacagcctggagggcttcaaggcaggaacatattgcttacagctttggagactagaagtctaaggtgctggtagggtgtcgcctgacatttcttgtcttcagcttgttaatggctacccattcctctctcttattctcaatacccatcttggccatgtattttatggctatcagcactgctgaatgtcaagtctaaggttcaaagttagaccctttaaataaggacctaaaagttagaagtctttcaggaaacttggacttgggttataaattgtactcttaaatctaaatgctcgcttcttgagttcttactatacaatttcttagatttttgcccttataggagcaggatgttcctggtagagtctggggtcagagaggagtagatgaggcaacagagatgccaattacatatgggcttgtgccaggtgatgggagataccttaacaccaggactggagggatggctccagcagtcaagagctcttggtggctcttcctgaggacccaggttctattcccagcaaccacatggcagctcacaattgtctgcaactccagttctagaaaatgatgccctcttctggcctccacacgtgtggtgcagacatgcaggcaggcagaacgctcacacacattaaataaaaacaaatgaacatgaccacccagattccagccccagggtcaaggataaagaataacatgattttataataaagatggcatattagttacttttctcatcactatgacaaaatacaccacacaggcgagtttagacttatcttggctcacagtttgaggagacagagttcatctggaagttgaggcagccaggcacactgcatccacagcaggaagcagagtaagatgaacactggtgctcaagtgctcagcccctttctccttctttttatttctcctttctctcctgaggtctcagccaatggagcagtgccaccctcatttaagatgggtcttcctgtctggattagcatgatctagataatccctcttggaagtttgtctcctaaataatcctagatcttgtcaagttgaccgatggtgactgtgaccacaatcacaccatctcctatctacagaaaagacaacttcactctccactgggctgagtgtgaagtccaagaataacatcagactcagtggtcagactgggagcagctgggaaatgtcctatttgggtcagggcaggctatttggcagtgaggttgagaacactgtaaggaggtcagaagccatctgggggttaggctattgtgggaaagggctagttctggtgcccagatgcccacaggactgagcaggaccatccttccagtggcttccatccagtcccaatctatttgacatacctgatgtatttcaatggatgcctcaacactgcaaatctagagcctgcctccttcctgtccactcaccttcgagaacctaatgagtttgcctaggttaaaatgttttattgaagcccagtgatggtggtatcactgagggaataaatcctaaactaataaaagttgagtgtaatctaaaatagcaattaatctctgttgtggagaataagaaaaatgaacaagccattgttgaaatatttattagcgagaaagacgggacagatgcatttgttctgaatggtggttgcttgggtttttgggttgtgtttttgtttttgttttctgcctctgtggtgtgtgtgtcagtctgtgtgtgtctgtaggcacacatgtgcacacttttcaggtgcacaaatgtgtacaggtacatgtgtgtgtttgtgtatatgtgtgtgtacatttgtgtgaagtcagaggtcaaacttgggtattattcctccagaaccatccttattttttttgagacagggtctctaactagcctaaagtttgcccagtagactaggctgtctggtcatcaagccccagggatctgcctgtctccctggaactagaattacaagtgtgtttctccacattcagctttttttttttttttaatgtgggttctgggggttgaacactttaccaatagactgagctatctccctagttccctgctccattcttaaatagaggcggagtagaccgagggatgactctagagcatacagggttcaagacatatgatctgaagttaaaaggccttgtcaattcctaggaattatgggttttcccctacaaatgctagatcactcctgcgtatagcagtactttctccttgggaccaccagcttataaataatgacacagagacttcttattaattataaaagctcaacctagccaggcgttggtgacgcacacctttaatcccagcactcgagaggcagaggcaggcagatctctgtgacctcgaggccagcctggtctccagagcgagtgccaggataggctccaaagttacacagagaaaccctgtcttgaaaaaccaaaaaagaaaaagaaaaaagaaaagctcagtctatagcttaggcttgttcctaactagctcttattacttaaattaacccatttatattaatctacgtcctgccatatggcgttacctctcttccatcttgcacctcctgttttctctctgtgtctcctggcttcccctgcacacctagattcctcctcctcttcctttctctcccgggaaatctcacctatacctcctgcctagctattggccattcagctttttagtaaatgaatcagagaaatataccttcacataatgtacaaatatctcacaatatcacctgtatagatggaagttttggtcccacctggtcccacagtcgttcagtcccaaataaacactcagaggctatattaattataaactgtttggctgaatgctcaggcttcttattggctagctctctcttaactatgaacccatttctattcatctgtgtatctctacgtggtcttggcttcctagtgttagtgatgtccagacctctggttccttggcagctacatggtatctccctggctctgcctactaccttttctatccctgttttgatttcccacctggctaaatcctgcctgtccattggcagaaacagctttattcatcaatcaattagggaaccatattcacagcacacagaaggacatccccatcacacctgcaggaaacacccaccaggcacctaaggttggcacctggaaggcaagggtccagagttttgtttcccaagggtggaacattgcttctgaagatggccaccgacaattcctcatgtccctagatacacttgccatttctcctcctcagagtctgagctggccttgtggatggctgagctgtaagaagccaagaagcatctactctctggcagccctgagccactggaaggaagtgctgcagaatgaggaccatggaggccaccctccctcatactgtagccacctcttccgaaggctatcaaggagaggggcaggtgaagggaacatagcaggacaataatacaagttgaaggctgaagttggagactgagtgtcttggtggggcaggggctgtccaacatgtggcatgttgttgattttgtcctggggatgaacccatggtcttgtgtatgttaggcaactaccccactaagctatatccccagatctgtgttttccattttgagacaggagttaccaaattgcccagactggccttaaacttaccctgtagcccacataggccttaactcatgatcctcttgctttaacctcacaagcaatgtgtttataggcatgcaccatcaagccttatatgtgccttgggatgtagtttagttggtagaatgtttgctactttaaatatgtcaaaaacaaacggctccaggtcagactccagaagtttgaaccagcccagttaagtcacgctgaacagggtttccttcttgtctctcacagtttctcttccagctgtagggcttgcaagtgataacaatagagtaacattagacatggaaaatatgtatgaatgtgtggtgacagatacaagaatgctctggtagctttgtttgtgatgtggtgttatgttgaaaagggctaagtggttaagagcacttgccgttcttgcagaggacctgggtttgattcccagcacctacatggcagctcacaaccatctgcaattccagttccaggggatctgatgccctcttctgacctctgtgggcaccaggcatgcacaagtggtgcagacagacaagcaggcaaaacactcatgcacataaaataaattaaatttaaaaaaaataagaaactggaaagaggttgaggatgtggcacagtggtagaccatttgctgctcacacacagatccagggctacagcccaaacaccaacactaagtgggaaggaacttggaatgaatctacacatcaagcaacaggaaaacggtccacatatgatgggggtccttatcataaaagtaaagaagtgccgggcgttggtggcgcacgcctttaatcccagcactcaggaggcagaggcaggcggatctctgtgagttcgaggccagcctggtctccagagcgagtgccaggataggctccaaagctacacagagaaaccctgtctcaaacaaacaaacaaaaagtaaagaagctaaaagaaatgactgagctacatgacaccatgagtaagagtcttagagacgcactaaggttgtatgctgatatataaatcaacctcactacagacccatcaaagcatttcataggagatatgtaactatatgcttaaatgtgtgtaagtactgtatggaagtactggggttggaactcggcacatgcgctgggttagcattctacaactgggctacactcacacaaacctgcaatatacacaatatatctatattatatgtaatatatttaatgtaaaatagcattttatttatttattgtatatgtgttgttttggaggcagactccttttttaaaaaagattatttatttatttatttatttatttatttatttattatgtatacaaatttctgcttccatgtatatctgcacaccagaagagggcaccagatctcataatggatggttgtgagccaccatgtggttgctgggaattgaactcaggacctctgaaagagcagtcagtgctcttaacctctgagccccgacagactctttttattttgttttgttctattttatttttcgagacagggtttctctgtgtaacaaccctggctgtcctagaactgtagaccaggctggacttgaactcacagagatctgcctgcctctgcctcctaagtgccgaaattaaaagcatgtgccactatgccaggctggacacagacacttgctagttcaagactcctggggtcaagtgattaccgtagcttcccaggtagctacaactgcactcagctttatttttgcggttgtgaggacactggtcttgtggttatttgttgtggcagctctaggaaacaaatgtaaccctccagtacctgcatccatgaacttttggattttgtgtgggctatgtgaagcccaatgttactgagaaccatgttttgctgaaaatttggtttaggtctggaaggtgctgaaaaggtcctgtgtcagctccgcactgttgtaaagtggaggaacctttgagaggcacatcccagtgggagcttttaggttttcaggagtgtgacttgaagaggattgtgggatgccagcctcctcctcactcacctcctgatcaccatgaggtgagaggcttgtttcatcctttgcttttcgttatgatacgctgcctcatcacaggcccagaggcaatggggccaagccaccatggagtgtaactgataaaaccgtgagccaaaatagactgttcttcctgcaagttgattaactcgtgtattttgtaatagtaatagaaagctgactaacacaggcaaacagaataagggctcttgaaccacacagcagactctacttagaaaataaggtcacagatttcccttaccaggccttccctggcaactcctgagttttcaagacttgagtgataatctggggtttagggcatctccatgctttcagtgctacccactgagggaactagaaagtctaggagtcatctataggcactgcaacatgctgttgctgaagacagattctggttagttccaaggacacttggtcattgccatcgggtgtccttgctgagtgtttacctgctgttgtctggctccctacagagtataaattccacgatgcagctcatgtctgcttcatgcaacactatttggggtttaatattggggtttaataaacaccagtcaagtcgatgcatatatgcatgaatgggtaaatgaaaggaggtctctaaagcaatggagatgagagtttcagagaaataatctaaccctcccacccaccccactccctcccctggagagcaagaaatagcaaatacttgccacacaaaagcttctgtcactttccgagggtggagacggttcccaaattcttagtccagtggttcagccatcttttgcaataaattgcaggaagataagaaaatggaacttgatagtaacaggattgaggtggttcagagagggttcttatggtggccattttaaaatacaactctgagccatgactttaatcccaggactagtgaggcaaagacaaggacagtctgggctacagagtgagttttaggacagtcaatgctacattttgcgattgctgtctcaacccgtgctctgcccccccgccccaaattaaaatacaactctggaattctctgccatccctcctacagaactgtagtctatgactcctcctcttgagtctgcatacttgaacaggggaatgtaacaccaataataaaaacccagagacagatatggggttcaaactgaaggtcagagaagcagagcagccaagccactaaagagctcttatctcgaccaaggctggaagggatcctgtcctcaatgtggctggagactaattgtcagagactgaatactgaatgccctactcctatcttatatacctctctagtgctgagattaaaggcacaagctctgtttctcttttagaccgattcactctcatgtagccccacgtggccttgaattcacagagatacacctgcctctgtctcctgagtcctgggattaaagatatgtgcggccactgcccagcttctatggctgtggctagcttttcattctgatcgtcagtgactttattagatcattaacaatgtatcagcacaggaaaatatggcagaaatgatgctatgtgggtttctaggaactgccaacttgggcacagtggcacaagtctttaatcacaacatttgggaggagacagaggtaagtggatctctgtgagttcaaggcctacctggtatacatagcaagttccaggcagccagggctacataatgaaaccctgtcttaaaaagaagaagaagaagaagaagaagaagaagaagaagaagaagaagaagaagaagaagaagaagaagaagaagaagaagaagaggaggaggaggaggaggaggaggaggaggtgggactggagaactagctcctggctcctcagttaagagcacttgttgctcttgaagacctgggtttgattgccatcgccacatacagctgtctaactgaagtcccagggcatccaataagcttctcctgacctccaaggcatgtaggcacatatattcacacaggcaaaacactcacatacataaaaataacaaaataatttcagaaaaaagggaaaagaaactcttggcttcttttgcttgtccctatacagccccggctggttttgaactggctaagtagctgaggatgaccttgaacttctgatctttctgcctccatctcccaagggttgggactacaggcatgtatcaccatgtcaattcattcttgctcttttaaatgctttttatgttttcttgttattttggtttttagttcttatttgtttattattttttatgtgcatgtgtttgagtgtatgtcatgtgtccaggtgcctgtggaagccagaggcatttttctcctggaactggagttacaggcaattatgagctgcttgacataggtgctgggaaccaaactcagactctctgcaagagctgcaagtgctctcaattgctgaaccctcgatccagaaccctgtgggttgtatgtatgtgtgtgtgtgtgtgtgtgtgtgtgtgtgtgtgtgtgtgtgtgtatgacaggcatttaccatgtagccctagctggcctgaagctttctacgtaggccagatctatctctgcctcctgagtactgggattaaaggcctgtgtcaccatgatgcccagcctgtcctattgatgactacaaatggaatcagagataggctaataaccagtaatttattaggggatatactcacacaagggaaccagtgaccagattagcaccccaagcaggttgggcccagaatgcttcccagtaccggctcagcctagagagagaccgtgtgctggccctccttgctcttatacaccctgctatgtacctgtgaccacgcccaagtgggcgtggttagtggtacctgtaatcagggtctcttcttacactgtccttttttttttctttttttctttttttttctttttttggtttttcgagacagggtttctccgtggctttggagcctgtcctggaactagctcttgtagaccaggctggtctcgatctcactgagatctgcctgcctctgcctcctgagtgctgggattaaaggtgtgtgccaccaccacccggctttttttttttcttttttttcttttttttaaatgtagaatcttgctttgtagtgtaggctggaccagaacttgttttgcagcctaggttggttttgaatttaccattctcatgttttagcctctctagtatgaacagttattcttgaaactcagccatcacactgtgaggaaattctactgctttgagaagagacccatatggagaggtaccagcagccaatttgcctttagtggggacgaatcctccagtcttggtggatacattgcacctgccatggcacaagcaaaaatgagctgtctctctgaatcctgcccaaattgaggatcctgagaaaagcaaatgttttctgtcctctgttactaagttgggactctcagctcttccgctgtgcttagtctctacagtcaaggtctgtctcccttctctgcctttaggcctcctgatgggcactcagcctgaagagacagctcacaccccatgaagagatagctcatatctgcaccagtgagatggagtgagggattttcctctgccccatgttcctgcaggaggattgcttagcctaaggaccacccaccacctttcaccttcccagcatccatgtggagatctggactgaaagcttcacagccaagggtggcttctggatgtgggaatgacgtgtgggttttgttgaagctatttcccatttctttcatccctgtggctgtttattaacctcatgcactggctgagaaagttgaatgccgcatctggctcgtggcttccctgtcaagtcctgttgctccttctgaatatatactctctgaactcggggcaaccgtctctgaagttgctgctaagtggttctgaaacatgtttagataccatttagctgcttgaatgacccagtggctgccacattaacctgataaactgtaggaagccacttgcctgctttcttcctcctggcattaggcagtgggttgaaccgaccctcacctcaaggacactttggacttcaggaggccaagggggcctcctaggcagagacagatgtgatctcaattttaatctctgtgacatagtctcatattcttatgaccttcgacaaaaaatgacagctgcctggctgaggggctccacgtctgtttattggggacaatgataacctcagaaaggttattttactttagattttaaaatctttatttagtttttgtttgtgtgtttacttgccggtatgtgtgccatgtgcatgtagatgccctctgaagccagaaaaggacattggatcacctggaactggggtccaagtgattgaacataggtcctctgctggagcagcaagtaaagagttgtttgaagggtctgagatgaggtacacaatccacacgttaactgaactcttggccctgtgagatcaacacaagatgagttcaaacacaccacttgcaagtttaatgcttgttaaggggtcaggacaatgtccatacaaagtccaagttaacctctgggcctcagttttattatttgcaagtagagatataataaacacctcctcaggctattatgaaaatgaaggaagtaagtgcttagtaaacacccacaacagacagcgctacaatcaggggcagctgttagcaccctgtgcttcgttaatccagacgtgaaatctaatccatttcttatttttcacatcaattttgctccccgccaatatctgaactgctgtttagatggtaccctgttgattcgtacatcttttatggttgtacatgctaggcaaagataagtttagaagtgtaaacatacaaaataaaagaacaaatcaaagttaaaaaaaatggaatagtagggtttacaaaacgcgtttggatgcagtagtggagaaaggagttactgtttgctacatgaactgtttaagttgactttggcatggcaactcttgtttatttccttattgtgtttatttccttatgctatgtgacgtgtgtgtttgtgtgtgcgcgtgtgcgcgcgcacgtgcaaaggcctaaggtgtcttcctcagttgctttccagcatatattgtaacacagggcctttcagggaactggagctcattgttcagcctaccttgactagccagtttactccagaggttccctgtttctgtcgtggctcacaggcaagcctcgctatgctcacctggcttttctcgtgggctcctgggtccaaactgcagcctctgcacttgtggagaaagtactttacatggccatccatctccccagcctatttttgatttagttttttgaaggaagggtctcaagtggcccaggctggcctcaaactcactatttagttgaggataatcttgaacttctagtcctcctgcttcttctacctcttgggggctagaattgcaggcaagtgtcatcctgctggatttttttttttttaactatagtactggagaaggtgttcagggtctcctgaaggttagatcagccccaccagctgatctaaagctctaacctatagtaagagttatttatgtaatcatttgatttcttcttcttcttcttcttcttcttcttcttcttcttcttcttcttcttcttcttcttcttcttcttcttctttaaaaaaagacagaatctggatatgatagcctaggatgattttgaacttactgtcatcatgcctcagtctcttgagtgatgtgccaccaaagctcaggggctatagacccttgtcttagccacaaacaggaaaattctgaatatctttaaaacatttatatttactatgcatctgagtttaggagaggaaaagaaaaatctcctaaatgtctgaaaacaggagtgatcttgaaacaaggatacaaactctaagaggatccatgtgcttctctaagaggatgttgccacagcccctgggaggacccatggtcttcagggattagatgtgttagctttctgttcctgcagcaaaacacctgcgaccttcaacttagaaagaagaaaggtttatttggcccacagttggaggtttcggtttatggttcattgactttgtgctttggggctgtggtgagggagatgatcgtggcaggaatcatgtgtcatagaaaaatcattcatttcatgactggtagcaagacaaaggaagaggaggaactaaggtcctatcagtcccatgggtccagtgacctaagacactcccacacccctctatgcccatctgtgaaattttccatttccttccaagggatgcaaactaggagctaaaccttgaacacacatgcctttggaggatagataacacccaacgtataacaaaaatgggctagagacagggttgtaatagccctgtggtcaggagatgatgcccagggggcatgagaaaatgatctagaactaatatcaatttaaaccagagctggagcctgggaagaaaatctttcccctgaaaggggtctagagtttctcaagtttgggcccagatctgaaggcctaatgtctgaggtgaaactggaataggaatccagaggtcaacatgagccatccatcagggcccgagcagacagaggcagagagtgataatgaggataacagtggccactcgtcatgagcccactgtgtgcacacactgtgcctagcacttcacatttaactctcacaacttaccaaggtagatgccattattgtcacctaatggctgtgtttacagatttgggcaattaacagatgaaaacaaaatagctctccatagactcagaaagctagtgagaaaggcattctagaggtttttgtttggggtgagggtggaatggggtggggtaggggctgtgcttgtcacagcacaagtgtagaggtcagagaacaacttctgccatgtttgccccagaagttgaactcaggtcttatctggtttgattgcaagccctttcactaccaagccatcttaccagccctatttatttatttttgagacagggtctcatgtattcctgcttggcctccagtccactttgtagctgagaaggagtaccttgaatctgatcctcctgcctccatcttctaaatgttgggtgtggtgttgtgggtctgtaaccccagccctagagaagagtgaagacaggtttcagaagcttgctggccaaccaatctagttgaatcagcaagctccagggtcagtgagagaccccaggccaaaaaataaggtggagagccattgaggaaacatcaagtgatgctggcctctggcctacatgcccatatgagcctgcctacccatatgcacacatgcacgtgaggatttacacacacacacacacacacacacacacacacacacacacacacacacgcatgcatgtacacacgcaaaaatataatcggaagaatgccatcagaaaacatccaagagccagcacttgggaggcagagacaagtgggtctctgtgagttcgaggccaacctggtctacagacagaattccaggacaggctccaaagctacagagaaatcatgtctcaacactgctgccctccccaaaaggctacagtattgaggctggagagatggctcagtggttaagagcactggctgctcttccagaggactggattcaattcccagcaaccacatggtggctcaccacagtctgtaattcaagttccagtggatctgactccctcataaagacatgcaggtcaaacactaatgcacataaaaataaaaaacaaagtatatttaaaaaaaaaggaaaacatccaagactttcccactttgctgtaaatctgcctatgtgatatttccatcaatatatttgaaaaatgtcttgatttataatttttctctgtgctgttcctataaaaacctcatgaaactactcccacactggcacatgggatttgagctcatctaaacatgtatccctgggtcatggtcacgcatattcagcattggagtaaatgatctcttattccctttgaggtgagagctgtgctttcacattgacaaaggtttctagctgaggctttgacctgtctccttcaatcagagcagggactttttgtctgttttaagggttggtttttttgtttttgtttttagttttttatttttcaagacagggtttctctggagccttggagcctgtcttggcactctctctatagatcaggctggcctcgaactcacagaagtccactgcctctgcctctgcctctgcctcctgagttctgggagtaaaggcgtgagccaccacgcccagctttgtatctgtctagttcacttgaggcagggtctctcactgaacttggagcttgtcattttggttacgctgcctcttcccgtcaccattttcatctgttcatactgtgcttctccctcaggagactcacttcactgttaaacaagtaataatcaaactataatacagtaaaagaaaacaaaacaagaatccacaaacactgcagtcaaatagaatgtctatttgctgccagtcaggtgggtcctttccctcacagcatcccatgatgctaattgtgccattagcccttctctccaacttctggatgggcactgtactgagtctctgtttaggaccatgtcagcatttggctcggaggaaatcctctgacctggaagaattccctggctcacctaggaggtcaaggggcagagagacttgggggctgggcacactttttccaggatgtaggctgtttcctggctctggggctcctctcccacagcaagaataagaatccatttcctgttcattatatttacctgaaaggtaaaacaggttctgtttttggaagcctcttgattgcagccttataaagaagctccacatgcagaatagggggaaattaattggtcttccagggagcagctgaacgaagtctggtaattgaatttcacaatgaatgcctccctctgggtggcccgagtgtgatctggaatggatatttgaagttttctctgtgtaaacggcttgggctcctcaatgtttatatttttggtgggcatcactcattcacactttcatcaagaaaaaagaaatgtacatttccttacaaactctgaaatgatagaaaggggaaaaagagggggagggggctggtctcatctggagacacaatttggcaggctcttcgcagagactggggaagagccaactgagagaataaattattgcttgaaaacaggctgtgtcagagtggagctgcagacccagctgctaggtatcagagcagcctcagggctccgttccaaaatgagttatgcttggtgaggtcgggagccggaaagaacacatgaggtcatgatgccaatcaataccttgaactggtggatgcggactaaactgccctcctcgagatttaactcacccagctgcccagcaaagacttaactaactgtgtgtttctgtctcgacagaatagttactagtgaattaccttggccttgggatagccatggaagacatgcaacctcaaccctgggtgggtaacagaccttttcagctcctgaagtccaggttagaatcagcaatataaaatatagtcagctgtctagatctgtggattcaaccaactaggaatagaaaatattaaaacaataacgcaccctcccaataaacctcaccttgttaatattgagcacatataggctatttttcttgtcatgattccctaagcaatagtcttgcaaatatttacatagcatttactcagtatgaggtaggggaagccacctaatacttctgaagtcatttaagaatgagaggatgtgtgggttatatgcaaacaccgtggcgtttttttatttcttatgccgagcattgagcccagggccttgttcacaccaggcaacctgggagttacatccctagccctgttgttttacagaggacgaactcttgattttgatatctgacaggtgtatatgtgtgtgtatgtatgtcctggagtcaagcctcagtgtatactaatggatggttatatactactagaaatatatagaataaataggattgtgatgtgaaccacaaatgcaaatcacatatgtaatttaaaattttttagaggctgaagagctggctcaggggttaagcccagttactgctcttctagtggacctaagttcgttcccagcatttatgtcatgataacatgatcactggggtttaatggccaacaatctaatggtgagagaccttgtctcaaaggagttgttttaggtctaaagccttctccactcaccccaaatagcagtgctggtgacactgtcccaaacagaaggacttgggccagtaaacagaagaattgctgctgggtaaacaagcctaaaaagagtttttgtttacaagaatagaggatctgctatagtgggttcctaatctgcagagagaggtggggcttgcctataatccccagaaggctctgcaggaggatcataaatctgaggcctgctgggcattgtggcgcatgcacacctataatcctagcactctagcggcagaggcaggtggatgtctgtgagtcccaggccagccaaagctacagagtgagacactatctcaataaccaaaatctaataataataataaaagaagtctgaggtctccctggactacatgatgagactttgtccccaaaagaaaagtaggaaagaagtcactactgagatgaatcaatgaaagaaaggaagtgaacaatattgttgcatctcacttatggaactgaaatttccaaaaaacaaacttgaaattgttagacccccgaaaactcaagtatcgggatcccaggccacgttcgaggtcaccccaatcaccaggtgcattcgagagcttgctgcaaactgcacgaggctttattgtaatttaacgagctaaccctatgttagctcgggtctttcacccacccgccatggcggatggctaggaaagacggcttctagggtctcccaaaagatcttatagggcagcataaggggcgtgtctaggtacgcacaggcttacgcacaggctcacgattggtgtgcttccaggcttggagggcttgccctgtgttgattggtcaactggttgttatggcccataggccctcccagggtggttgctatgctctctacgtcattgctgtgcgcttgttcgtaaagcacacccagggtcgtaaagcatagcgccaccagctaacttccgattggctccttgtcacgagacaggcatctgacctctaagtgaccaaggcaggtttatggcaagcacgttttcggctgttatggctgccaaaagggaagctggttccttcaaaatcattaaaaaaccaaagctgtccaccccacaggaaaaaaaaaaacaaacacattcctgactgggggaggaaaccttggaccagaatattttagcagagagagtacagagaccaggctcgctaaagaagccaggactcagcagccacagagctctgcccctggccaccataaagttcttgaaccaataatggcagaaaagacacccaaggcagctctttggctctatttcaaaggagaaaacaaactgattttaattgcagagggataaggattaagggtgatacagagaaaatacaagtcaagaaaatgtgagcaaggtacaaggatgggttagcatctctcttgttctttccgtgtgtgtgtgtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatgacgtagagagcatagcaaccaccctgggagggcctatgggccataacaaccagttgaccaatcaacacagggcaaaccctccaagcctggagggacaccaatcgtgagcctgtgcgtacccctagacactccccttacgctgccctataagatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtgtgtgtgtgtgtgtgtgtgtgtgtgtctgtgtctgtgtgtctgtgcgtttctgtgtctgtgtgtccgtgtgtctgtgtgtgtgattatgtgagagaaagagtgtgtgtgtctgtgtgtgtgtgtctgtgtgtgtgtgtgtctgtgtgtctgtgtctgtctgtgtgtgtgtgtgtgtgtgtgtgtgtgtacatgttgttctagtttcattctgtttctgtgacaagtatggaaagcagtttagggagtggaaggtttatttcagcttacacttagaggttacagtccatcattgatgaaagtcagggcatggacctgacatagaatccatggaggacactgcttggtggctcactcacaggctcatgctcagctttctttcttatgtagccgaggaccatctatctatctgcctagggaatggtgctgcccacagtgggctgggccctccaggacagtcccccatagacatgtccacaggccaatctgatctgggcagttcttcaattgagactcccttctcaggtgactcgaggctgtgtcaagtcgacagctgaagctaactagaacatgtttgtgaattctccccccccccccaatcaaaagtagtataactgcagacctgcatgggaagaaaacaaagagacagatgaaaattgttttatatttcaaaaacatgataaaactatagtgaagttcaattaaataatttttttgcaggtctaggcattgaacgaaggacctcacgtattcaaggcactaccactactctatatgcccagtcccttaatttcagttttcaaaagaacacaaggtaagatgccaaatagatggatggaacccaaggaggccaattgacagcccaaactgcaccattatgattaataaatctaaaaccacagagaacacacttctgacaaacacaaatgctaacacaaaggaaagagtctagatgaccgttatgagctttgaggaaagggacacaggcttaaaactagagaggctgtcagaagggttcagctggtgaaggtgcctgttgacactcctgctgccatgcctgcctctgcccaagtgtgatgtctgcagtctatggcagaaggagaaaactgactcctgcaagtaatacacacagagagccacagacacagatacacacacacacacacacacacacacacacacacacacacacacacacaccatttaacaagaaaaagcctggatggtcatgatagaacacacctttaatcccagcgcttgggaggcagaggcaggcagatctctttgcgttcgaagccaagcctggtctacccagtgagttccagggtagccagggatacacagagaaaccttgtgtcaagaaaaacatggcccctcaacaccaacaaaaaagtctagcaggcatgggaaacaaagattcaatgcaaagaaaatagacatcagcaagtaaaagacaaaggaagacaaaatcaaaatgataaaatgaagagatttctcttaataaaacaaagcacaagccccagtatatagaaatatggtgttcttggaaactttaattaaaaatatctcacactgaaacataatctatcatgagaattccagaacattccacgaggaaagatggcaatttcaacagtgtctagagaacacgaaaaggaatagagttgaactccacctgcccattaaaatcaacttaccatgaagcaaactcctagagataagaattaaaactattacattcttagaagaaaaaataagtgaaaaatctttgtgttaggtaagtcttgtaaatgtaacatctcaaacatactagataaacaggacctcaccaaagttaaaatgtttgtgctgcaatagcccacaaaacaagagaagttatctgcaaatcatgtgcctgtaagaatctattttgagatcatataaaggatagttaacaactcagaagagaagaaacaaacagcgcctttaactagcactctgaaagctgaggcaggagaatcgtgattttgaatttgaggctagtttgtgttatataatgagatcctgtctcaaacaaacaaaaaaatgcatacaagcaaacataaaaatgggcaaagtagtttgggtgacatgcctgtaatttcaggtattggaaaggctagagcaggcgatattgagtttgaagacagcctaggcaacacagcaggtgctgcctcaaaaatcaattagaagatggggagtggataccaaatagaaaatatgtaactgttttttttgggttttttttttttttttttttttggtcttttgagacagggtttctctgtgtatcccttgtctgtcctggaactcactttgtagaccaggctggccttgaatttatggagatccgcctgcctctgcctcctgcatgctgatattaaaggcgtgcaccaccgatgcccatcaataaataactcttaatgttaatggtctcaacttcctaataaggaaaacaactaattaattaaataattaattaaaatgaatggacatttctctaaagagagacaaattgccaagaagcacagggacaggtgttcgccattagccgctagggaaatgcaaattaaaaacaacaaacagtcaatagtgctagggagaaattgtaccctcataaaattgctgctgggaatctaatatactgcagttgcccagaaaacagcttggcaattccttgaaatattaaaaagagactcagggacccctcctgcacatgcattccaaggaactgaaaacatgtttgcagtgaaattcattccgatgtctggacaacattcttcattttagtctcaaactgaaaacaacccaattgttattcatcgatgcttgttgacacctgcattgtgatggttaatcttgttaatcaccctgacccactgcccagagtcctgaaccgaataaaaaggagcaatcaagcagggtgttggtggcacatgcctttaatcccagcactcgggaggcagaggcaggcggatctctgtgagttcgaggccagcctggtctccagagcgagtgccaggataggctccaaagctacacagagaaaccctgtctcggaaaaaccaaaaaataaaaaataaaattaaaaaaaaaaaaaaaaggagcaaccgagtggaacaccagcgtccatgcctctgtgtttcctgagggtgcaatgtgaccagctgccttacatccctgtggccaggctttccacaccaagatggactgatcgtcagaataggaaccaagacaaatccttccttactcaagttgcatttgccaggtgttttgttacagcaatgaggaaagtaactaatacacacacacacacacacacacacacacacacacacacgacagaatattatttaccctgacagaaagatgggattctgaaacctgctatgacatgaatgaactttttcatttttatttatctgattatttgatattatctatttatttttgctaagtaaaagaagctagccctccccaccccccaccaaacaacatgctgtctgatttcatttatatgaaatgtccagaatgggacgaaatgagacaaaaataatacggataacaacaaaccaggaaaaccaggaagtaaaagaagaggaggaaagtctgttacgatttcaaaatgatcagacaaataaaaccagagtgtaatataagaactaaccacaaggctttgcaacctcaagtcacaaatctaagatggctattataaaaacaatctcttgaagtgtgcgactatttattttgaatttcaatatttattttagtttcttcagttcccttttcttctagtaaatggtaacaaaatatgcaaaaagcaatactattcattaaaatttggatttacagtacaactccaccttaatcaagtattttgctagttctgtgccggcacagagcaatgtttacaatgctgtttctttggtgtgaggtgtagatcctggtgtctggtgtgatttcttcccttacctcttcttcctagcattattgtattcttcataaagattctatcatttttccccaaacaataggattaattttctaagtgcctgaaaaaaaaaaaaaaaacatgccgggattcaacatgacagcatatggtttgttattttggtactttttatttttctttatttttaagatttctgctcctatcccttgctatgagccgcactgcttggctgggtcctggcaacctgactggatgatgagggagtgaagaaaggacagacacaaagggtgggaattggtgggtcatggccttggatggagtgggccatggctttggatggagacatatcagcagctgggaaacagcacatttattacctacctctgagaggagatgagtctattgtatacagctgaacaagcaggtagatttagctcatctgggtaggcagtctctacaggggtgcagtctcagtctgtaatcagccaggaggaagctgccaggtaggtggattctttgtgtcaacatcccacactgactgggggaaagctttgtcattttcctgagcctgcctgcagcaaggctttactattcccacgtgtctgaggcattccggtccttgacatgtctgtgtccacaccaacaatatacattcactcagcacttcatccattgccacaatccttctgcaggagactgactcaatctttagaaaaggctgaaaggaactgcgttttgtagctggttttgtggacatacgcctgtcatctcaggactctggaggttaagacaggagggttgctgtgagtttgagaccagcctgggctggtcagtgagtcccaggtcagagctagatggtgaggctctgtttcaaaacatcaaacacacaaacacccactgcctaaacaacaacaaaaaagaaatacagaattgtggattcttttgtttgtttctttagtagagaaaaggtatctcaatagctttggcttaagtccttcctctaaggtatctacactcttgatgaggaaggcaagatgcaagtgccctgacttgagtgtctgggtgaaaatgtggccccagaacttggaaagagactcctttcaaagaccataatacaagcttagaccagggactaaaaagatgttgccacagcctggaccagcagcactcaaagacctgtagggccacagtgtgatagtgtgctgactgctggaggggaagagtgacaatagtaaccatcctgcaatcctgttcttatcacttttggacttaaagaaataaaagagccctttgatcccagcactcaggaggcagaggcaggcctccctagtctacagagttccaggacaggcagaggtacgcagagaaactgtctcaaataaataaataaataaataaataaataaataaataaataaataagaaaaaagaaacaaaagagaaacaaataaaagaatctctaacaattacttctgagagctaatgaatggttcactatggttctgtatggagccttagcctgcaagttgactgtgttttaaagttaccgtgtgtgtgtgtgtgtgtgtgtgtgtgtgtgtgtgtgagtgtcattcccagagactgggtcctgagacttactgattaggctagatagacaggctggccagaggatctatctgtctctactctccagcaccagggattgggattacatatgtactccacctggcttttatgtgggtgctggagatcaaactcaaatcctcctgcttgcatagttagtgctttattaggatggttagttttaattgttaacttttaattgtcacctggaaagtgtggctcagtgaggaattgcccacatttctcattatgtgggcaggttgtaacaggttgtcttgattactgtggtagcttgaatgtaattggcccccataagctcacagcaagtggcactattaggagatgtggctttgttggagtaagggtagctttgttggaggaagtatgtcactgtgggggtgggctttgaggtctcatatatgttcaagagacgcccagtgtcttacaccactttcttttgcatgcaaatcaagatgtaggactctcactcagctccttctccagcaccatgtctgtctgcacgcctccatgtaccaccatgatgaccatggactggacctctgaaccgtaagccacccagttaaatgttttcctctataagagttgccttgcagtggtgttggtggcgcatgccttgaatcccagcactcgggaggcagaggcacgtggatctctgagagttcaaggccagcctggtctacagagcaagttccaggacagcctccaaaacaatacagagaaaccctgtctcgaaaaacaaaaacaaaaacaaaacaaacaaacaaaaaaagagttgccttggtcatggtgttccttcatagcaatagaaaccctaagacagaagttggtaccagagactgggatattgctgtgatagaccagttttgtttggaataatatggactttgggagtttggcttaggaaagcaatagaatgctttaagtactgcttaatgggccatgctagtagaagcatggaagacagtgacactaagaattacttgaactgtagggccttggctcaagaggtttcagaggagaatattaatatgtggcctagagactggtcttatgaaattttggtgaatgtgactgtcctttgcccttgtccaaagagtctgcctgaggctaaagtgagagttttggattaattccattggcagaggaaatctcaaaacagcctagtatagacattgttgtgcagttactagtgttaactctaacgaagatttataatgaaaaggagaagactgagcagggtaaatgacaatgtacaatttgaggagaaaaggatcaccaggaagtggaagggagctaaatcctatgttcaaagagatgaacagattaagaagtggaataaagggagtggtgacctcggggcaagaatccacccagctaaatttccaacttatgaaaaggaattaaagaaaagcttagagtcaggtatgatggtacacacctttaatcccagcactcagaaggaagaggctggcagatctctgagtttgaggccagcctggtctacagacaaagttccagaacagccgcgcttaggcaatgaagtaaatcatggaaaacagaaagctggtgaagaatatattgaatgaggggggcatggtccagccccagcaagcagcagagcatggaagctttgtccacatggttctctggctctagagtcaaggataggagaaaggcattatggaaccttcctctgtaactaaggaaagccactgaggtgtcaggggtgtccctgaatggaggcccagtagagaagccggtgctcgaagctgtgaaggtgaagcctgcatttccttggtgaatgtaagatgttggagatgccagagtagtgggatacctgctgaggagagctgctagcagggagtggaaccagcccgagagagaaatgtgttgcagtcaacaaagctgaaaggagttggagatgccaggcggtggtggcacacacctttaatcccagcactcaggaggcagaggcaggtggacctctgtgagttcgaggccagccttttctacaaagctacacagagaaaccctgtctcaaaaaaccaaccaaaaagaaagaaagaaagaaagaaagaaagaaagaaagaaagaaagaaagaaaggagttggagatctgaagaccatcttgacatcagactggagacacagagtttggagttttcccagtaggttttcagtcttgttttggttcaatatttcctcactattctctttcctacattttggacaggtaatgtttatcctgtgctattatatgttggaattatctaattattttttgattttatagaggattacagttaagagattgcatgaatcttagaaaagacattgaactttggactttaaaacattgttgaaattgtgataaatgatgggaacttttgaaattagaataaatgcattttacattatgatattgttacaagcttacacggagtggaatgtggtagcttgaatgtaattggcccccataagctcatagtgaatggcactgttaggagatatggctttgttagagtagggatagctttgttggagaaagtgtgtcactgtgggggttagccttgaggtctcatatatgctcaagccacatccaatgtcttagaccacttcctgttgctgcagatcaagatgtagggctctcagctacttctctagcaacacgtctgcctatatgtcaccacctcccaccatgatgacaatggactgaacctctgaactgtaggctaaccaattaaatgttttccttttaagagttgctgtggttatggtatctctttgctgcaatagaaaccctaagataattaccttaaattaattaatgtagggagatctagcctagtgtgggtggcaccatttcctaggcatgagacttttggagagatattcagccacagaggcccccaggggaatgtgaatcaggtattcaaagtgggatctgttgagaatcatgggcttgcttattgtgaattttctcttcattcctaattcacccaaaacttctttgcttagtgctgtttattattattattaattattatcattattgtctttaaaaataggctagcctggagctcacatctgactcagtgctgattttaaaattatttttttctcatgctctttttttttaaaaaagatttatttatttattatgaagacagtgttctgcctgcatgtaaccctgcaggccagaagggggcacaagatctcattacggattgttgtgagccaccttgtggttgctgggaattgaactcaggacctctggaagagcaggcagtgctcctaacctctgagccatctctccaccccccttttcatgctctttcactctctctaaatgaatgtattttgagactgtctaatgctgattaggctagccttaaactggctatgtagccaaagatgaccttgagcttctgatcctcctgcctccccctctcaaatgctgaaattataggcctctataccaggcttctgtgggtacttgtgatagagctctggacattgtgcatgccaggcaaacactctacccacagagctagagctacattctcagcccaccacatctgtcttttcatcaactaatattcatctctcagtcatttccggaaaggttctttgaaatacgtggttttatggtccattcagagaaagttatctacatcaggccctgaccatggatcctggaaaatcagcaatagaacagcaggcttttgtattgttttgtttcttaccactcactttatgagacctgctcatcaaagagtcaattcctgatgcaattacacatgtaacccatatgtcccccagtggctcttgctgtgagtgacctcagcaagatgggctcaggctcagttccatggcctgtaggcccacaggttcctcctcaggtgccgggagcccccaggggactcctgctcagtaaaacctgccttccagagtcctgattctggtatgaatctcagtgacccagatgtgaaactcagccacacacacaaacaactcaaatcacaaaaagcgttcatgggtataattagattttccctcagttgataaaaattttaaatacagacaagaacagagactaatctaataagtgtctgtgccctccaaatcagaatttagtgttatcactttacaatgtttccttccggtttaaaaaaaaatgtctaataggatataaagtgaaatctctcaggcacacccacctccctaaagatatatgcaggcatttggtatctgccctttgaaaacttcttctcatatatctactgtatcataaatgcctgtcttgcatggttttaagatccacataattgtatcatattttattttctgcaacaggcttttaatgcaataatgtgtttttaagagctatctttgatgatatatacatatagatagatgcagatatatacagttcattcatattaactgttatgtagcatgaatatttataaatttgtctatgcaaaactctacttgtagacagttaagatttttacaaagttccctctgtgacaaacaatgcagcaaaaagctattattcttgtatatattttatgtgtcagagtttcctttaaagtttctagaagtagaattactgggtctttggtgctctgtgggatattctggacttgttctcaggtgaacagcaggtctctaagaacagaagcctgcagagtttctggtgtctcaggctcagactggcataatggtttctgcctcgttctggtggccaactctagtccagtttagactcaaggaatagattagtgggcaggagataaggctcagtggttaagagaactgctgctcttccagaggactggggtttgatccccagcacccccatagtggctcacaaccaaccataactccagtactaggggattttctgatctctgttgacaatgatgcacacacacacaaacacacacacacacacacacacacacacattaaacactcatacacataaaatagcaaatacatataagataaaataataatgtaaaaaaaagtgtttgttgcttttttttttttttaagatccaagttctgttcccagcacccactattgcttcatagctccagggtatctggtgttgtcttctgacctccatttacctgtttttatatgtgcataccaccctgcaaccctcccccaggcatataacataatttaaaataatagaaccgggcaatatagtaacacacgcctttaagcccagcacttaggaggctggcttaggaggcagatctctgtgagtttgtggccagactggtctacagagggagttccaagacaggctacaaagaaaccctgtcttgggaaaacaaaaaacaaaacaaaataccactgaactggcactagtggggctggagagatggctcagtggttaaaagcactggctgctctttcagaggaccccaggtttggttaccagcacccacattggtagctcacaaacctctgtaactccagttccagacaccagtatgcatgtgacacacagacacacattcaggaaaacaccccatatgcataaaataaataaaataactttttttttttttggttttttgagacagggtttctcggtgtagcttttgagcctctcctggcactccatctgtagacaggctggcctcgaactcacagagatctgcctgcctctgcctcccgagtgctggaactaaaggcatgcgacaccatcacctggctaataaaataacttttaaaattaaaaaaaatagttggggatggacagatggcttagcaatcaatagcacttgttcttgaagaaaacccaggtccccactactcatgtggtggctcacaactatccatcattccagttccaggtcaaccttcttctgacccctgtggctaacaggcactcacatggtacctatacacacatgcaggaaaaaaaaaaacattcaaacacataaacaaataattctacagtgttttaagaagcccagtagagggcctgagaggtggctcagaggttaagagcactggctgctcttccagagggcctgagtttaattcccagcaacacccgtgcagatatacatggaagcagaatgttgtatacataataaataaataaaatcttttaaaaaaacacttacatacagaaaagtaaatttaaaaccaaccccccccccaataattgggaccaatgctggatgtggtagcaaattaggataaaaggcgtgagctaccaccacccagctgccagttcagtttttacatacaatgtaatttactctacagatacgccttaagcatttttgggtcttacattgaatgagttgtggtaagaatgtagagatttcatgtcatcacactgctaagtgtcctcttgtaactggcctggcaggcataaagatatctggctatcttgacacaagagaccccaagaaactggaagtcccatgggaaactcatgctggtagaagaaaatgccagccatagtggtaactttaatccagtaaataaatttacaatttttttttaaagattttatttatttattatgtcttctgcctgcaggccaacagagggcaccagatctggttgtgagccaccatgtggttgctgggaattgaactcaggacctctggaagaacagtcagtgctcttaaccgctgagccatttctccagcccctagatttacaatttttcataccaccttgctggaataactgcagcccagacaatgatgggtgggaccataacgtgactgtgactggagactgttgatagataattctgaccttgacttacaccttaatttcatttcagggtcctgaaaatgggtttttgggggatctctggttctctttgtgcctctttcccatgtggccacatggaacacataactttttttctatgtttccctgttaagtgtcttatcgaggatggggtgtggacctgacttgttaggtcacaggctgtgatgctctgaactctgctgtcatgatttccattgctcaaacttgtagaatcatccgctcagaactttaaagggtgaagagaactttgcttctcctatgtgagatccaggcaagaggcaagaacagtttcaaaccaggttaagacatcaccaggacagccaaggtggagacattgttccttagagttacagaggagaggggagcagagattggagtcagggatcaccccacaggtcctcgggcaggccagcaaggagtttggctgaaggatagagttgtgagaggacaaacggaccaagggaggcatttatggattaaagaaaagtgtttcaaaacagcccttcaaacctgggccgatattctgtatggaaaagggcaaattgcttgtacagcagaattcctggggagttctcagatcatagtgtgagaaagaggatggagaatttggttccacttgcaacaaagaatccttgtgaacacagaaaaggccagcattttggaaagggaaggctttgaacttcattcacatggagtctgtcagagggataaactgtgagggcgggacaaaaggtgatggcagaagatggaactagtgagggtgtctttctcagttttaactgtcaacttgacacagactagtgtcatctgaaaagggggtctcaactgaggaacagcctatatcagattagcctataggcaggtctatggtggaatggcttcacttaattatgtagcagggcccagcccactgtcaaagtaccattccctgggcaggtgggcctggcctatagacaaaagctagttaagcatgagctggtgactgagacaaggaggagtgttcttacagggtttctgcttctccaacgctagggtttttgactttcttcagtgacatactatgacctgaaacagtaagccacttttgctcaaagtgtgttatcacagcagccgaaggaaactagaacagtggggtggggtaaccaggagaactcacgtgcctgggtccacgaacagagcagaaagctgatctggagtgcttgagtgataagacaagagcatacccccctgtttagctcctcagagctgccctcagtctcttcaccaggtagcactatgcccaggggctaaccaggagtcttgctctctgagtttttgttgccctgaggaagacttgtagggtatgaggaggcaggagcgagtaatgaagctgatttcccccagcacactcttcactggagccaagccttgcaggccactcttcatcctagtcagttggtttcatagtcccataagcaccctttcttcttgtccctacaggccaggactcttcccccttccctcataatgttgcaacctctgggatggcttcacagcactgctgaacccctttagccctgtctacactttaatgtttgccttgttggctccaatctagcatcatctacttcctgatgggactcagtaacaaccatgtgaggcagtttctttaaaagggcacctgtgaatttccagggattattgttcctcttggctacataggcttagaaacacatccttttgtctggagtctttcctcccagaatgagtcttggtgggaagtagagttttctactcatgtagaatgtgaaagttctagcctcccttgcagctagggtttggatatatgacccaagctctgtcaatcagaggcacaaactagactttggataaggagtctgagacacagggacattgaggaggtagggccagtgactgttcctcgaattctgctctgaggaaccattaaggcctggtgaggactctagctagcatcctgcattgtaggacacaagactgccatcaggttggccctgtgtttctgctatcacactgtccaggtccaagttcctctgcctcccagcagggtcaaagctctctagtctcttgtcctctgattcctactctgcttagatttgagtcagcttataacttgcatttatgaattccagctaggggaggtttcctacctcaaatgtagactgtaatcagtgcttacctctgcctctatttttggtgcttcctcagtcatcccctgcctccaggtagctgtcattttctttccagctgtgcagtggggaagggggtgatattttgacacagggtctcatgtagccctggctgaatgatcttgaatctcctatcctccatgtttgctccagctgtacttctttattcacagaaaggctgtacagtctgtgagttaggagacatccactttaatggatcaaaatcccacacgaaaagctttctcactgtgaggctagagtcaagttattgcacctctgtgaactctcttgtctccttatctatccaatgggagacatcttgttgtgaggactgggtaagagaacttgtgtgtgaagtctccctaggctgcctggctcctagtcaccatcaataacagccgctattatctttatacacgccattatcatcaccatcaacatgattcaaaggccttatggagcctacttagaacaggcatcatcaaaccaaatacctgcaggaggcaggcaggcagcaaggacaagtgctgaagagtcatttataccaacacattggcacaaggtgggagctagagagaatgagagccaggtctgtctcaagggggaagccactgctcagcaatagccatttactgccaagtgaactgtgagccagatgatgccaggcttcacactatttcaagcaaagccaaaaattcagatctttatagaaagcttggtgcttcatgaaaagctacacaaacactgcactgaggtcacaacagactgaggaggccagttcgtgtttcttcatgtgggactctaggtccactttcaattgccaggtgacaacctgcttgggttgggttcattccatcggtacagtcattgatagctaacacccctgcctacccagtagagaatgtgagagacattccctgacacaggtgttggtctcaggcacacttagagaggagaagtaagaatttcaggtgtcctccaacagttacttttctgtgggtgtcaggtccactgagggtaaatgcttcaggatgtcagtgagcccccagtaactgcccgattaccacaggttcagattctcttatgtatgttatcacacgtccagaggtatgaagaacaggaccaggacacagattaaatgtatctacaggatttcaggctttttccatcttttctcagcatggaaagttttgcctcagtggttgcaggatagctacaaccacacctatcatgattatgttctaggcaggaagaaaagaatatgataaggggtggtccttatactaaaatttcccagaaacctcagcgtatttccttttctatttcattggccagagctgctgcccacatcagtacttagtcacaaaagaaacgagatgggatatttttagatggttacacggaccatccaaacaacatcaggtttctgttaattggaaacaaagtgagaactgagtgagagtaagcaacctttagcctctgcagcctcctctgaatacagactacatgtcagaccccagccaagtactagagacctcagccttccctggatctcagccacatgaacacaagtgattggatctcagtttgaaatccaaagcctattcagcagaaagatatgggagtggttttaaaactcaaccaagccaccaagtccaatgctgggacagcagctctgggtccctccctgtcctgttctcccatacccctctctgtccccaccccttctgtctctgtggccccacccaggcccaaggatggtggggagactgtgtgattaacaccactagcagtttcaggaggcacccaagagagacattctgagagaaatatgtccgcggcacagctggtttataatgtgtattaatccctgacatgtaatttgagtaatatatgtaaagcagaaagttcaggcgctgatttaggggccttattattaccctgtcagcagaattcatgttctatttgcacagtgctctgggtccagcatctcatcctgggtgacagaaggaggaggtttcctgatggagacagctgatagcgggggtataggtggatcctgatggagacagggtgtctgtcagtcaagtgcttagagcccccagcagggttgccaggtacctacatagcccagggagctatggaacaaaaccaggttcgtactacttggcctggaagcagatccatgttcattcctcaagagggccataactgtaagtctagaaagtcatggtttggaattcaaagccaactaggccactttattatcatgtgactttggacagttttcccagttttttgatggttattccatatgtgcaagtgggaatcagaatagcatccatctaactgaggcttaaaaacaggttctgagcacttatgaaggactacagtggaattctaaatgtttgacatgttttctcaacgaatccccatagcaacctaataagatggatgtatgatgccccaacttagagttgaagaaaataaggcacagagaggtgaagtaactcattcaaggtcacacagcaaatgactgatagagcttaaagttgccctctgagatccaatggaacgttctgtcataatagaaatgctttataattctatgctgtctggtaaaagatccacttgccacaattggccattgaatgtttgaatatggcgattttgacagaagattctaactttttatttaactgtagctactttaaatatagtggttggtggatatgcagctctagactccccagtgctctctgactacactagagggcttagctttgacaactgttggcctagaaccccaggaagctcctatgttagcaaggcttccgaaaaaaggaccacatagccatgatggcacacttataatcccagcacttgggaggcagaggcaggtggatctctgtgagtttgaggtcagcctggtctacagaacaagttcaaggacaggctccaaagctacacagagaaacactgtctccaacaacaaaacaagacaaaacaaaaaaaaatcaaaaaacaaaacaaaacccagtgctagagaagtggaaacaactggattgctggccagctagcatagactacttaataaattcctgtaagagaccctgtctcaaaaaaggtggaaggctcttgagaaacaacacttgagattatcctctgacttccacagcatgtgcatatgtgtatacacatatgtatgaaaacacatacatgctcacacataacaagaacaacaaaacaggatcatgtaagggagaaagagatgaccagcgtcagttgttatgtctttccctgtgccatgcagaataaatgctgctcctttaagatgagtgggtgttatggtgtgaacattgaggttcctcaaaattcatcttgaacctcggtgcccaggcaacagggaagtctaaaaagtgggacctttaagaggtaattggtgcttcttacaaaagctcaagcgggcatgttcatctcctccatcctttctgcagtgtgagggctcatgtctcatcttggcagcaacaaggtgctgttctagaagaaggaaacagcctttcccagagtctcactctgccagcacctttatttcagacttcccaacctccaggttgtgagccaattagtttctgtctgtcaagaacacactgagctggtgggtgttccgggtgtcaggctggggttggagagaaagcctagtttggtgaaggtcttggcatacacacgtaaggaccagctcccaactaaaaagcttggcatggtggcatgtttgtaatcccagcactgagaaagtggagacaggaggattcctggtatgcactggtcagccagtttagtgtaatgatgagttccaggtcccagtcagagatcacttcaaaaaaaaaaaaaaaaaacaaaaacaagatagatgccctgaggaagggcacccaaggttaacctctggtctccacatgcacgtgacctgtacacacatgaacttacatacacacacacacacacacacacacacacacacacacacgtaggggaagctgtagccacgcctgcttaggggctggctacaggtgtgcctgaccacgcctgcgagggcatggtcagggtgatgtagagtgagaggcagtcaggtggccgggttcagtttctgttttgctttcggcttgctgtacagactgctgccgcaccagctggctaggtcgctctgtaagttgtcgtggcccggcttgtctcagctttaacccatgacagccatgaggttctacctgagtgggggtgtgtgaacttggaagcgtctaggaacgcaacgacgataaagaccaaacataggcatcttgtcatctttagagagctctcagttccatgttttggaactagagccattagtttattaaccatcttttctggtgtcccttaacatcctgctaacactacgaggcagccatttctctcttgttctctctctgcttgcccacttcgctcctaaccttctgtcctaactcacataccaccaaccccgctcctaaccttctgtcctaactcacataccaccatccccttctcccaggtgagggcctattcagatgctaggcacatacagatgcaaaataagaggcatattaccctcaggccaggtaaacagtaacagcctggtgttaattaacaatacaatagcgggccatagtttcctggcttcacggctcctgacagccagaacctggggcccaatatttggtcctccacagtaagtaaggctttttccctattaaaatcccttgtatttctacctggctctgtattggtaatttccacattacacacacacacacacacacacacgcatacacacacacatcctaggcccttcagagagccccaggatcctagatactgtctgccagtgagctaagatgacagacacaggctctaatcttctacttttggacctggcagtctagtagagaagatgatgttaaacaaatggccactcagctaattatagctgacttgtgattttttgactttgcgatgggtttgttgggtcataacctcatcataaatggagtaatgtctatatttataacagttaattaaagggccatctgagtgcatgccaataaagcaaagtgatcaaacggcagttagagaaagtggttggagaagcctaacccagcagttgtgtctggggctttaggagatggtttgtctcagatatgttgagaaaagaggaggggcttgaatttagtctaaaagagttagaagttgtagccagctgtagtggcccatgcttatgagccagcctactcaggaggtcaaggcttctgtccagcttggataacatggcaaactgctagctcagacaactggggtctgggactggtgagatgagtcattgggtaaaaatgcctgctgtgcaagcctgatgcctggagttaaatatccaaacccatggtggaaagagagatctggttcatccaaattgtcttctgatctccacatatgagcatgtcttcccatcatgcacatatacacagtcatcaccatcatcatcatcaagtcagatgctgggatgtggctcagttggtaaagtacttgcccaacatgtgtgaggccttgggttccaaacccagcacgacacatacacatacacatgcatgccctaaggcatgcgcgcgcgcgcgcacacacacacacacacacacacacacacacacacacacacacacacatccacaaggtagagaaaaataggttaacatatcaggggatgagaggctggggagatggctcattggttaagagcactggctgctcttccagaggacctgggtttgattcccagaacccattttacttctcacaatcatctattatttcagttccaggagatctgatgctctcttctggccctgtggataccaggcatacatgtggtacacagacatacatgcatgaaaaatacccagatacataaaatgataaaaaatattaaaaatattttaaagtacacccaacaagctttccagtagcaggagcagtgtgggtgaaggcatcaggagacagagtccttcaggtcctgacctcaaaatacacaatgactgggagcactggtgaggtagccttgggaagatgatgtccctacccccttgccctcctccattgtgaaattattccaacttacactgaattgttggctgttaccctgaagtgatgcaggtttctgcatagggacaggtgtgagttttgtcttcaaaagcaattcagctgtattgaagagtatacaattgggccgttttctagccaggtaactgtgacattcctttaggtctaacatcactcttgggccatccaacctactttccacagggaaacttcagggatcttttcaggttttgagtttttcatgcagttaaaaaagccaaacattttagaaagttcatctctcctgccctctccatttttattgttgtgggttttgttgttgttgttatttgttttgctttagggtctcatgtaacctaggctagtctggaactcacaatgtagatgagatgaccgtcaatttctgatctttctggttcttcaaagtgctggggggatccagttcaggatcttgtacaagttggcaaacactctaccaatgagttacattccagtcttctgtcccctcttcaaggaatcactctgtctatctatccatctatctatctatctatctatctatctatctatatatctatctatctatcctcatatctatctatctatctatctatctatctatctatctatggcatgtaacataggaagggatcactttaattagtttttttttttctgttctcttcaccagacttttctgtacattctatgcatggaagttaccccacattcttgggaacatttcctcctcattcctgcttttgttggtagtaagtgtgtgtgtgtgtgagagagagagagagggagggagagagagagagagagagagagagagagagagagagagagagagagagagagatttgtttaggtgctcgaaattgtacccaggggcttacacatgctatgcaagtgctctaccactaagaaatgactccagcctccaaaaggaccctgctggttgtcctctgacctccacacacatgccacagcaatacttacccatgaacacactcaatgagtaaatgagtaaagaagcatatagtaaagaagcatgcaggtaatgaagttgtgaactgcttttaactaaactgcatgagtgctttgttcagattctcatatggatataagccctcatttctcaagtataaatgcccaagtacgcaactgggttgtatagagttacatatttagtagtaataaaatgcacataacatggctcacgcctttaatccctgcactcaggaggcagaggcatgtgtatctctaagtttgaggccagcctggttgatggaatgagttccaggacagtcagggctacacagagaaattctgtcttgaaaaacaaatacatgctatagatttacccttttaagcattttaagcgtacagtccatggcattaagcacactgacattgttatataaccatcaccatcatttgttgccagatctgtacccattcaccacacagcaacgtcctcttcctccctctcctagactcttataaccaccttataacgcaagcacatctatgtgtctacatatcatacacatacacacatacatatatatagagagatatagatatatagatatatatgaaactaccaagtttttataggtcagcctcagtatttaacattctcatagctgacataggaatgctccagtttccattactccccattggcatttaacactgtttttttgttttgttttaaccattctgatgtgtgcaccgacaaaaggctttgtttacacatctagattctcattctacagatacgtgaattgcaaacattttctcaacagggtctttcacagagaaagtgttttgattatttttattatattagtgtatgtgtatgtatgacgtatgtgtggtgtgagtgtgggcatgtatttgccacaacatgttctcttcttccacctttatgtgttccagaaatcaaactcagatcatcaagcttacacagtgagcatctttactcatggagccatctcaaagaccaagagaaaatgttattttgtattgttttgtttttccacagggtttctctgtgtagccctgactgtcctggaaatcgctctgtagatcagactggccttgaacttgcatagatctgcctgcctctgccttccaagtactaccccacccagcccaaaatgctattaattttaataaagtccagtttatcaattttatcctttattgaccatacttcttctgggggtcaagtctcataactatttggcaatctgttttgagttagtattttttttgtttgtttggttttttttttttttggtttttcgaggcagagtttctctgtggctttggaggctgtcctggagctagctcttgtagaccaggctggtcttgaactcacagagatccacctgcctctgcctcccgagtgctgggattaaaggcatgtgccaccactgccctacttgagttgatatttttatgtgtcagctttaggttggttattttcctttcccttgattctcttcttctcttcctttcccccacacttctcttctttgttttccctgtgcatgatcagttgctgctcctgcaccatctgtttaaaagacttcaaaagcaggcacggtgccacacgcatggaattctagcattggaaggtgcaagcaggaggactagaagctgaaggccattctcaatttccatcttcaaaaacggggtttggggctaggtggtggtagcacacgcctttaatcccagcactcaggaggcagccgcagttgaatctctgtgagatcgaggccagcctggtttacagagcaagctccaggacagccagggcttcacagagaaaccctgtctcaaacaaaaacaaaacaaaaacaaaacaaaaaacaaaacaaaaccccaaaaccaaaccaaaccaaaccaaaccaaccaaccaaacaaacaaacaaaaaaaaaaaacagggcaggagcaggagctgggcattggtggtgcacacctttaatcccagtactcaggaggcagaggcaggcggatctctgtgagttagaggccagctgagtctacaaagctacacagagaaaccctgtctaggaaaaaaaagagggggggtggaggtgggggtggagaccatccttcttccagttgaggactggagagatgctcagaggttaagagcactggctgctcttccagagggcctgagttcaattcccagccacaacatggtggctcccaaccatctgtaatgagatctggtgccctcttctggcctgcagtcatacatgcaggcagaatgctatatacataataaataaataattcttaaaaaattctttacaacaaacaaacaaacaaaaaacatactcctactggcatatgacaacgttactgtggggttatcagtcttctagctgggcttattgtctcccatctttctggaaccacaggttaaactgagcttatttaatggttggagatgatgggattgcaagagaatgtacccagcggtgccagcatatttcagaaccttttgttcatgtctggtgacattctatcagccaaagcaagactcttggccaagctcaaagttaaggcaagaaaattaggcacagtctatggaggtagagtcaagagaggcctggcatcagtagaatctatcacctaacaaaagcaagaggtttctcttcttataacggcttttattcacatgggacctcaagctctctttataaatattccctatgttcccttctattctaaagtaccacagtacaattaaccctcaaaataatgaatattcacaatactttcttctcttacctgacagaacagggttttagaaaaattcacactcatttttctaattagccagcatctcttcccaacaataaagaaatgagacattgcaacattgactccgagtttctatctctacacttcctcctctgcccagcaggctgaggctgctgcttcttagaggactgacaatagcccagtggtttctgctcaggcttttacatgcacacaaggtcttctgtttgagaggaattgtgcattgtgcaattcttcataaagaatggctttgttctagtttttaaggttatataaggttacaaaacataataaattaatttagaaatgatccaaaaaggagagagaggataagagtcagaacaatcgctaagacgtctactttctttgctgccttgtgtggttgaagagaagagacttagagatttaacagggaagttatgcagtatggcatgtgaccagggaatgttgccctaccttaataccttttcctaattttttttttcctttatcactggtgtgtgtgtgtgtgtgtgtgtgtgtgtgtagaataatttgccaggaggtattgcattcctagagggtccatacaatatttttatgtgcttgacgaccacccattgtcagccacggttaagtttctctctcatcccactcacactagtggacaggtgaacatgtgttgccatggaagcctcctggaggtgtctcttatattttggggaatatatgaatcggtcaagtattctttttggaagagatagacagccagttgctactagtttgagcaagatgaggatgtattattggtctatatgtggcgtatatatttattggtctatatgtttagggcagagcagatctgagggatacctggattcaggaatccaaacttctccaggttcttcctcttctccaagggagatgaataaggacaatggagactccagaattacagcctttgggctttagtaacttctggaggacagaaaacatatcaccttttgtacagtttggatcttgtttaaaaaggaaatgaccttaactggcctggtttgaatcacttgtttatggcctggaccaatcattagcagaatacagatgaggaacactggggaaatcacaggaaaccatgaaatcctgtgttccttatgagaccagaactgtgaggcaagtggaaaacagcctgttacttttctttctttctttctttccttccttccttccttccttccttcctgccttccttttttttttttttttcttgagaccgtgtttctctttctagtcctgaaactcactctgtagaccaggctggccttcaactcacagagttccacccccctctgtctctcaagtgctggaattaaaggagtgcgccactatgcctggcccttagttacttctctgttgctgtgataaaatgccacgatcaagacaactaatacaaggaagagttaatttgggagcttccagttccagagggataggagtcctctatcaccatcatggcaggaaagcattgcagcaggtggcggacacggtggctggagcagtggctgggaactcacatctccaacaataacaggaagcagcgagaacaaactcaaacggtccaagtctttaagctctaaaaccaccccagtgacatccctcctcagcaaggccacacctcctaagcctctccaacatggtcaacaactgaggaccaaatagtcaaatatcagagcctctgggggccactttggtcaaagcaccacacaccctcccccagtctgcactgtaggaggttggcggtacattgtattggagggggttgtgatctggaagttcttcccgcactgacatgttgtaaccctgatgtaaaataacactattcaaggagacagctccctctcaagatgtctttggtggcccttcagatttggtccttgtagatcgttgcctagggcaggttaaatgctgctgaggtggctggacttggatgacaaaccaggtagcaagtgcccagctttctgagatgtcacttttggaaacacgaaaacacattgaccttgaccccctgggagaaccgattcctgtcctgcttcatagtgatctctgtttggggtttggcaaatgacctggacaccagggttgggccacaacagccccgagtgctaattctagatctattttccgggttctgccataccactgatcaaatccccctctgtcatctcctgtattcctcttcaagccccccccccacatcttcactcactcagaagccttaatgagcactgtagaactttcttaagattggccaaaggtattaagattgccaagtagctgaagcagggggatcacttgagccaagttttaagacaactgggtaacacaggggattttttttttcctcaaaaaataatcaaacaagctgtgtggtggtggcacatgcctttaatcccagcactcaggatgtgtaatggggggtgagggtggaggtggaggggagccaagacaggtggatctctgtgagtttgaggccagtctgtctatagatggaattctaggacaaggagattatacagagaagccctgtctcaaaaaattactaccaccaccactactactaattaaacaaaaggttggcacataaccacatttatctattttaaaataaactaaaaatgtttaaggtgtatatgtatcatatgcttgatgaatccacatttaactagtttgttgaatgacagacagtatctgccttgattctaccatattcttattgcctattagccccccccacagaatatataatggatctgatattttaaaatattgaatgatatcttagggtatcttcagataagaactggatataaatgtaggtatggcagtgtgggcctgtagttgctgctacttggaggctaatgggggaagatgcttaaggctgggagtctaaagccaacctaggcaacacagggagaccctgtcaaaaagaacaaataacaaaaacaaaacaaagcaaacccccccaaaaacaacaaaacaaacaaacaaacaaacaacccaaaaacctaaactgaaaacaagtagtttagttggtgggatggatccaaggaaccagtttagtaaggggtggggcaggaaagaaagtctgccgataagttgttattttccactgaaagcaactaggctcaattctgctgagggcctctgggagacagtcaacaacgttcctcagagttatcctatgcagtgggaaaggctatggaggtcaccgtcacttcaccacctgtcataggctgatggatatatctgtgggcatttcatctccggtcctccactctggtctcctgagtataccaagattgctcttacggctgggaatacccctcagctgcgtcctggttgcagtaatcatgtctgaagtgtccagtcagtgacaagtgaattccactcctctaaaccatgtattattggctcttgctactccactggatcagtggggaggggagaggggaaggtgaatcacatgtggaagtccatatgtcatccttggtctcttgggataatataaagatttcccagagacaccagcttgagtagaagggctggggtatgcatacagactctttgactcaaacgtgatggagggctgctgagatgactcagtggctacaggcaacctgagttctattactgggaccctcatggcagaaggagagaactgagttcagaaggttgccccatgagctccatgcgactggaatgacacatcagaagcatgtgtgtatgcactcatacacacacaaatcaatggactagacatggtggtatagtctttagtcccagcactcaggagacagagtaggcagatctctgttagttcaaagccatcctggtctacatagagaattccaggtcagccaggaatacatagtgaagctctgtcttagaaaaaaagatagataaataaataagtaaatgtaattttaaaatattgtcaaaaagtgataaggggattgaagggatgactcagtggttaagagcactggctgcccttccaaaagacctagattcagttcataggacccacacaacagcacatacacacacacacacacacacacacacacacacacacacacacacaccctgctatcctcagactgctgaatttgaggcatccaaattggcaacccgatctctctggcacacagctctctcatctaagcgggaataataacaactcttcctcacgggttacttcgaggattcagcagagtgggatgtgggatgtatttagaactgtgtcagctctgagtaaatggttgtcattaggacaacctgtatcactgaaactttcagcccaccctgggaagcaatctgccttccatcgattctaaactgagggcagtaatctgcatggcataggtggttgtgattctgaaaggagacacaggtaaagcaacaatagctaatgtttactgagcacttgaatgagctagctattatgctgttatgagtcagaaatgtatttgacatgaagaagcaagattcaaaacagcagcacaaacactggagactttctttatctcacataacaagaagtctaaagaatctgagctttgtatttcttccctgtcaggttcatcaagtcaattcttgtcctcaaggtttcaagatggctgctatacctcagtgtatcaaatctgtgttccaactaatcatgaagctagtgagtggaggatgaaatgaagggacaatgagggcatcatgcaaaaggctaaaggacaccagctggatcttgcttaaaagccaaactcaaagccaggcaggtggtacatgtggcggtacacatctttaatctgggagacagatctctgaattcaagactattctgatccacatggtgaattcaagactagtcaataggaccctgcctcaaaacaaaacaagcaaacaaaaccaagaacttttctagtaacaccagacttgtcatcatggccaaccccacctgctagacagcctaagaaatggagccaggttttgacaagggagactaaatttggatgcagtcagtttataatatatgccatctatgcattttcctgtttaatcctactcaagattgagtgagtagaagcaccatttgttatagatgagtgaactgaggccgggagagacaagaactagcccaaagtacacagttcacaatcagcagaatcagattagaacccaggtctggacccttctccattaaatcatgttacaaagtgttaattcatttccttgcctgcctctcctatgaggttccaccagcttgatgctgctgaggctgggcttctgcaccctgtccctacagtcacagggacaggagagctggagataagaatccaaagaaagaatgaaaactaccatacccaaagattctctggtctttaggccttgtgacctaggtgagcttacaaagttgggaccattcttgtgtgtgtaggacagggtgggctgagtgattatcttttgatatgggcataaatgctagcagagcattttcaaataattgtggtcagcatagtcagctaggcagtgatggtgcatgcctttaatcccagcactcaggaggcagacactggtgaatctctgagttccaggccagcctggtctatgtagcaagtcccaggacagccaaggatacacagataaaccctgtcttgaaaaaccaatccttcctgctcccccaaaaagaaaaaaaataatgtgattaaagggtttcagatcagcaccctgcaggcctaaacgactttaaatttttcagacgaattaataatattttactgtttggaaatttcacattgtaaactaagtttcccgtttctctaggggaaaaatagcaaaacaaaatagttaactgggtcacatgggaactaggatccacttagtgaccctttgctggagcggggcagtgaccgaaccttttcagggatcatgtggtcaccattacagtactcaccccacctacttcccttgtctgtgccaactgctggtcttgaagactgggactgtaagagcttgagttgcttatgctcatacagccacagaatggggcaactaggaactaggtcacggtgacttcccctagtgaccttccaccatagctgtttctgagggtcttcacctgggtgggagctctacccctgcttggccatagcttcctcacctataaaatgaagacattaacaatatcattctttcaggagggagagggttttttgcttgtttgtttttgttgctttttgtttacaacaacaaaaaactgctcttatgtatgtgtctttaccacagaagccagaagaagagtgtcagttcccctggaattggagtgacagacagttgtgaactgtcatacaggtgctgagaactgaatcagggtctatcttcaagagcaggaggtactcttaatcactgagccatctctccaggcccaaatgagaagctgagagctgaggagctaggcaacattactgaatgactattgtcttagtggcttattgctctgtaataaacaaagcacccctcctgcagtttggaggtttaaaatactacatgatttgctcaagaggttttcagtctgggctgggctcagctgagtagttttacaactgactttgctcatgagcttcttttcttgttatttttttttcttactttctttttggtttttcaagacaaggtttctctgtgtagtcctgtgtcctagaactcactctgtagaccgggctggcctagaactcagggacctgcctgcctctgccttcccagtactgtgcaccaccaccttcccatttatgatcattctgtgtgcattggttgagcactgggctcagcagggaagctgccatgattctccacatggtttaagaatctcttctccttatgtattttctccatatggtctctccatcagggcagctagacattgtctagggttcccaattccaggaggacaggctttgatgtgcaaacacttgtagtgcttctgcatgacttatgcttgctgaggtcccactgtcccatccttggctgacattagagtctgagtgccaggctgaagatgtcactcagtggtagagacctgtctaatacatgcaaggccctggtttcgaacctcagcatcacaaaatggaccatgatactggagcatggcactggaggctatcagaataattgtctccacatcattttcatgatgtataatgggtagaagggagttcaccttcacttttagggtgaaattggatagtctatgtcacccttttcagagctctcttctctgaaccagctcagatttcaattttgcagctctgcctagaaagttgagggtgtcagagaaccagactaagtttgaactagtttttaatcacttggattgccatgattgtgttcctgtggagaagggtttcactgtgggcaggaggacaaggcctaaatcaggcaccatctgagtcccctggctgggttcaaaactgagaaggttttcggctacctggtgaagaactgctgaagtgcagcaaataaaaccatctgagaccaacatccaggcatgaactctcttaaaataatatgaaaaagtgggtttggagaagcagatggggaatatagcgcgtgaggcctgctgacacgcacatggaaggtgagggcagaaacgaaggtaactggaaagtttctggtggcatttgcacctcttctgaacacaagagtggggtaagggtggaaggacctgtgtagctgtcatttcctggacattcagtcttttatttatttttttaataagatgcttcggaaatgggttttctcgttaaaacaaatgctaccgaatgcagtgtgtcgatgtttatattccttctaatgtgcttctgcttgagcaagcaagcccttaatgtccgtttcaattaatgcggctgcctctgatctgggtgctgctgctcttggatgcaatgcagggtgggggaggtcactggggtgtgggaggcagtgctgctcttgtcagggcccttagaggcccctggcaaagaagggaagatgtggaatgagtcactgcctccttagtgaagaccatactttaaagatgccagcctgcctgctgcttgataaaaaacgagcgtggagaccattggcaaggcagagaacagagcaaaggctccgagagcccagccagtgaggagcttgactgaggagaactgtccctccaaccctgagactccagcaaccagccacaagggtggagtctgtgagctacaagtttgctatcctcgggtgccctgattctgccacatacacctcatgtcatgatggtgtcatgacatgatgacatgtcatgatggctcagagctagtggtctcattccagcaggtctgccggtggcctgaggtcaggatgtcggtgtgagtgggctgggctgaggagcagagcaagctttagagagaaacagtcacaagctgccaagccttcctccttctcttccttttcccttctatcatcccacaagatgtttaggaaaagaatatggatttatattgtcccagagtcaagcttcagaatgagttccccctgtagtaagtcagtgctcttgcttttcatctcatgacaatcttttgttatgccctctcaccggagaacacctgtgtgtcaggtgataataaacacattatttctagttttccaaataactttctaggtaaatgttaatgtgtccactttatctatagagggcaaaattggggtgcacagaaccacagaagcttgtcccgtaagtagcaggattggggtttccagaggcctgctcatttcgatttctggctccagtgtcatcaattattgagcagcagggagggccaagttcctggctaaggcttgctaatggatgcatctgaaatgagaaatatcttcaagtttcagacatttacagtgacaaagattcaacacagactagcctgcattgtcctaggagtcaagatgtgaagctcttgccctgttctgttaattcttctgatatgcagctttcagtctaaatgagttcctgtctcaccattggtacttgaacttgaaaaagaagaatgagaacatatggcggtagaaatagaagggaggtttcccagcccaaaccacatgaaacagaagatgatcagcccttaaatttataagaaaaaacaaatcagggaatagagagatggctcagagattgagagcagtgactgctcttccagagaacccagcacccacacgtggctagcaaccatctgcagctccatttccggggagatgtgaggctctctttttgcccttcaagggtattgcatgcacatggtgtacagacaaacaggccaaacactcatacacccataaaataaatgtaaaaacagtaacaaatcactgctttaagtcaccaagttttgaggtcgtttattttgtagcaacagataacataaacctcaaaggtgtctgtctagttacagactttaacagcgagagactgccagtttttagaccacaacctacaattattggtttgcagacataatttatttggcttgcatagggttatttttcaaaagatgatctgatacttagaaactgggagatttcatatgagaatccctatttagagggtctcttggaaaaccttgcatctcacacctgcgtcctagcaacagctggctagctgtcacctatctgtgtgtgcactctatagtttaccacagtccctccactccttgttatcttgctcctaacatgctttctgacccctgcaggcatttgaatttttgattcatgctgttggcatggcaatgggaaggcactggaggcttctgaggagaggagaaaggataagagctgaacagtgagtaacgcattggtgggggcgactctggagcatgtgtagtaagaaaagaaaatctattcttcagtctgtccagagccatgaactccatcttttgggaaatgctccttccctttctctgattgtaaggttctaattgagccgctgagagctccctgtatctcccactttcccatacagcaggataggttaatgaatgacactcagagttggggagagaaagtggctgaatgtatgccacagggctcagatagctttgggtttaaatcctggctccctcacctaccatctgtaagaggctggccatgtcacatttcctcatccttgaaatgggggagaaactgactttgtagggttgatacgatttaaaaggacagttgaataaaattaatttttacatgtttccccaaccttgacactgtaaaaacctttttttttttatccagttgaatgtggaaaccagtctctagagcttgtctattttttactcttatttttctcaactcgtacgccactctctagagccctgtagctcttttatgcccatcttcacatttgcttttccttctgtgtggcgtaggcagacttctgtaaatgaaatccttatgaaaaatgtggaccctattgggtcctactcatctttggttagttttagttaggaaattgcagcttcaagttagaaaaactactcaaactaggaaggtgcatttgttatagctgaagtccagaaatgggctgggaagatggttcagtcattaattagtgtgcttgccatgaaagcttcctcttcccataaaaagctgggtactggtggcacatgcctttaatcccagcattcagggaggcagaggcaggtgtatctctgtgagttcaaggccatcctgtctacagagtgacttccaggacagccagagctacacacagaaaccctgtctcgtaaaacaaaacaaaacaaaatctgggcataatagcacacatctgtaattccagtgctgggaggcaaagactgtctagctaaattgtgagttccaggtcaagaaactctatctcaaaaaataaggtgggggacgctgaaggtggcttacaggttaagaatacgagctgtttttccagaggaacctgattggattttcagcacctgtatggtggctagcaaccatctgtaactccagttccaggggatctgatgccctcttctagtgtctgagggcactgaccacatatagggcacagacacgcaaggagacaaaatacccacacatataaaatagaaataaaataaatcttttaaaaaaggttcttctacagtgtaagtggtccgaggtgacctgtgaaatggtctgagaccctcttttttttttttttttttcttttttggtttttcaagacagggtttctctgtgtagctttggagcctatcctggcactctctctggagactaggctggcctcgaactcacagagatccacctgcctctgcctcccaaaggcgtgcgccaccaacacccgacttggtctgataccctcttaaccaaggaaacactacaaactcaggcaaatcaagtagttcaaacttccatgcatatgacaagaatacctgtaaaactgcccaagcaggtggtcaatgtaatgcatatttgaaaagccacctagtctgaaagatgtcacttaaagaagcaacctgtgtcattctgtcagtataatggtagaactgggtggtgtgtcaaggccaaacactatgtctggacatgatggcctgaaaaaggtgttgagcttttttctggacatgcttaaaaatgcagacagtaataatgaacttaactatttgaatgtggattctctagtctttgaacacacccagatgaacaaagtacctaagatgcagtcctgaatttacagagctcacggacagatgaacccatacacgagtttctagaacaaagagttcccaagcaagaagaaaagatatcctagaagaaatgaaaacctacagtatgggaataaatacagcgtaaaagctagggagagatggcagagaatacccatgtcaacttttgtacacacacacacacacacatacacacacacacacacacacacacacacacacacacacacacacacgtaacaccaccaccaagtaaaaagttcagaagtgagtgtatcttctgaacagtttctttaggtttttggctcaatttttcagaaatgttttctaggttctgtcttccaaaacttctacatcttgtcttttgactgctgtctctcatgataactgagaaaaaaaattctcttgcgatggtaggtattgttagacccccagaaaaactcaggtatctggggtcccaggccatgaccccggtcaccccaatcaccaggcagattcgagagcttgatgcaaactgcatgaggctttattgttttttaatgagctaaccccatgttagctcgggtctttcacccacccgccatggcagatggctacctagagatcttgtagggcagcttaaggggagtgtataggggtacacacaggctcaggattggtgtgcctccaggcttggagggtttgccctgtgttgattggccaactggttgttatggcccatagccctccagggtggttgctatgctctgcaagtcataaagtacacctagagtcgtaaagcatagcgccactagctaacttctgattggttccttgtcacgaggcaggcacctaacctctagtgaccaaggcaaggtcatagcgagcgcgtgttactgtcatggctgccaaaatggggggctggtcatttcagtatcatagtagactatgctatccaggaaaaaaaaagaatatctcttcttcactcatcccttttattgagcaactaccctgttttttttgtttgtttttagtttttatttatttattttgagacatggtttctctatatagccctgactgttctggaactcactatgtacaccaggctggcttcaaactcacagagatccacctgcctcttgaaggaaccggcttcccttttggcagccataatggtcgaacatgggcttctatgaccttgacctagacactagaaagtcagatgcctgtctcgcgacaaggagccaatcagaaattacctggtggcgctatgctttacgaccctgggtgtgctttatggacaagcgcacagcaatgacgtagagagcatagcaaccaccctgggagggcctatgagccataacaaccagttgaccaatcaacacagggcaagccctccaagcctggaagcacaccaatcatgagcctgtgcgtaagcctgtgcgtacccctagacactccccttacgctgccctataagatcttttgggagcccgtaggagccgtcttttgctagccggccgccatggtgggtgggtgaaagacccgaggtaacatagggttagctcgttaaattacaataaagcctcgtgcagtttgcagcaagctctcgaatccgcctggtgattggggtgaccgcgaacgtggcctgggaccccgaatacttgagttttcgggggtctaacactctgactcccaagtgctttgatcaaaggtgagcaacaccacctcctggccctgccctgggtttttaatagtttaggaagactggagatccggttcagcaattaagcacttgttgcccctgaagaggatctgagttcatttcccagtacccacaaggtgtctcacaactatatgtaactccagttccagtggatctgatgccctcttctgaccccttcagacaccaggcatgtatgtagttgtacatatatacatacagtcaaaatactcataaacataaagcaagtgttaaaaaataattagggaggacatatcatattcattaagcatgtggactctaaaattggactccatcattttctagctgtatgattttgggaaagttaacttctttcatgactgcttgctcctctatggggattttaatagtacatatttcataaggctgttagggagattatataagcttgaaaagcagtcagttcactgcctggcaactagttagtgctctataactgttagctagtgttgccagcatatttccttagaaacatcttccttcaaattctcatcttattagattgttttaggcattaatgtctttttgacatttcttggttgaatttgttatagtcaaccataaaacaaacattaaatgagggggtctactattttatgcactgaagagcaaataaaacagacaacgtcctgtccttatgttgatcatactgtgtggaaagtggggtgtagcagagagaccataagcaaatatacagatttcaggtggaacattgctatggagaagaatccatggagaaagggtgtaagtagtgaagggctgctatctaaaatgtggacaggtaagacttttatgtgtgtgtgtatgtatgtatgtaattatatacttctttaaagatagaatttcagtatagccttggctggttttaagagttggtatgtagaccaggctggccctaagctcccagagatctgccctgcccaggtgtggggactaaaggcatgctccaccactcctgtccatgtaagacttctttttagaaagcctgaagatggctgtccatagtggtgtacaccttaatcccagcactcaagaggcagagaaatctctgggagtttgaggccagcctgacctacatagtgagttacaggataattagagagctacatggaaagatcttatcaccaaaaaaaaacttaaaaaaatacctaaaaaaaaaaaggaagaagaaagttaaaaaaaaaaaagaaactgttaagatggcgaggagtgaacttgtggtggtatcttgcttgtacaaataaagcctgtctggaggtcagagaatggagcttgccactagctaaccatagaggtctggagctctgtacatacagacaggaagtgaggtagctggacagaaacaggatgtaagcagggagaaacaggaaatctgttgtcttgtctgctggatgctaaggaggtaaggtatgctgtggcttgctccttctctgatctctcagcacttccctctgtatctgactcccgcctttttattatctagaccatttacatgagccaatcaatatctaggagaagactatttgaggccaacacaacagcaaaggcaaaggcccagaaggagcagtatgttagaccaggaaaaagaccataatgtagctagagcaaaacagcagactgaaacttacaccatgtcagaaagggtaaccagtgataagttacacaggacatggaagaacgtgaacaggattgttgtgcaatttttttcataatggaagccatgaacagagtagggcaacagctgcaacttgcctagtagtggggttgagagatcagaagaggtggctcctgagttgagtattagatgaactggaggtatctggagagaagtggaaaagtgaaaatgccacaacacaaggtgttaagggtggtggcggtggcgcacacctatgatcccgggagagagagagagagtcagagagagagagagagagagagagagagagagagagagagagagagagcgtgtgtgtgtgtgtgtgtgtgtgtgtgtgtagaagcaggatctctaaggccagcctggtctacaaactgagttgcaggttagccagggctacagagaaacccatttcaaacaaacaaacaaaaacaaaacagacaggtacattcaagcaaatatggtaagactagtgcacagagaaggaagaaaaagtaggctggaccgatggatagaagtgtttattgaacactagacatttcttacttcatctgtgacaggcattgtacaggttcggggaacgcagtaatattaaaaattatcagtaaagaattcctggtcttggcgctggagagatggtttagtggcgaagagtggttgttctgcaaggctgagaacctgtttggatcatccattctccacctaaaacggcctggcatcgctgtgattccagcaggtagaggcaggaggatcaacatcatttttggctacagagcaagttcagtgccagccttagctacatgagtccctgcctcgaacaaatcacaggtctgcagggatggggaatccagtcttctgggagctcagtagttagagcaggcaatggtcctgcttgtgctcccagacctctgattgtctggagaggccagagtgtggatgtggatgggagactgaaacattgattcgaacgggagatcctgacacaagaactatttaagagggagaaccaacacccaggttaagtaagaaaacatttcatctcgtatgggcaaaacaactcgactaagcttcttttatattccctttgaggaacggcacccagaccccgggacacgaagcctctccgcccaaccctagtcttggcagagtggcagcactctcactcttaattcctagaaagtgaaataaccgggctccaattacttcagggccctgcccgcatcgcccacggctaacccgcgggggccccatctccaggcctcgcccactcaagcaccaccccgtcgctcctccttccggctcctgctcagggtttacctcacaccccctccagctcgctctgcctccaggcccgcccccttcaggcccgcggcaacctcgcgtcttctgggtttctcttagcaccgcctccgcgtccctaggcccccgcccggccctaagtcccctcctctgggcacgctctcccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctttccagtccgggccagctcttggtgttctcttaggcgcacagatttggtgtccccccctctccgcccccccagtggttttatcgccttcctcgccacccttgccaatcctttggtcgttgtcacctggggcgccggaggggccaccagccctggaactggtctcacactttgtttctgtcctcttagcggccgagcctcagttttctcctgggtgaaatggggtcaagaaggaacgcagcctcgcagggtgttagtgtattcagggagggagttagtacatgacagaagcgttacatgccaacaggtcacgttcaattagactgacccaggaacttcgtgaatgtatcgcctaatgtccacagctgaattccagagttgtccctactcaaagcagcagaaatccagttgcagagaaatgaaatagccgtagaagtgcaaagctgttagtaacttacttatttcctgatatgaacatgtgtcatctcttgttcagagggcattttgatttaccgttaggattaacatcatatagttaagaagaaacgtaactccgggttcctccctgagacattgacctatctgccacagataaaatccccctttgttgctatcagaactctgagggaaaggtgattaggattaatttgttttgcttggtggtgtggttagaggcatccagagatctccaagcctccaatctaaatgaagttctgagcttaaggacctcaccaaagtccaccttctgctttattgcatgtctctctcttctcccaaccgcaaatcttgtattctccatgttcgtagttggaaggtcaggggtgtaggtagctcaagttaactgcctcaactccctgccttcaaatagtgttattctttgtttcccagtgaggcctagaggggttaaagtgaactaaaatgaactttggcaattgttttctgtggtcagtatgatattggttgtggggatcatctgagaaatcagacagggccaggtcttgaggctctcatgtttgcattagtttttcaacctgtaggtctgctgtgctttcatccttaagattctagatttggtagtggtggaatatacgagtggatggctcaatagaccatcccttctttgcttttaactgatccttgaaaggggcaggttgtctaaaccttggtgattactagaattcttggtagcctttcagtctagtgtcatcccccccctcccccagtttgttgaatatgatctactttttcagtcctcaagatcaggagtctcaaaagaccttgtgtagtctcagccactttctgtgcccccatgtctaaagagcaggtgtctgtattttaaattaacacatttgttttagtttcctaaacaaatggtttaggtactctcctgatttctaatttattgtgaagtagtttgcagggcttgatttatgcctttgtagtgtcaggcagtagagacagattaggaaggacttttgctttaggatcacaggatttaaccagcgttgacttctacaaggagctgagccattcctttgagtggccctttgagtctggtttttccagacacggttttcctgtgtagctttggagcctgtcctggaactcactctgtataccaggctggtctccaactcacaaagatccacctgcctctgcctcccaagtgctggcaagtctgttttcttatgtgtaaagtctcatagggtgctgtggagacaagaaaatgattgtgaaaatgcttgttgcagtaataatagctaacatctattaatcagtcgtaggactgaagatcatctattaatcagtcataggactgaagatttttagtggactatgtcatttgatacttggaacaatatgaactaagtattatccctgctttacagaagaaactgggcttaaagaaagattacatcaattggccaagctggattcactctgcagacagtaacagtaaaatcagattctttgagaagttgtggtgccatccatgtatgtcatattttaaatagttggcaatgcaacagttttacagtgtgcaattctatgggaataagtatattttatattgttgtacagctgatatctccaaattaccttacctttcctaactgaaattctcctggtcaaacacttttaacttcttgttgaagattcttggcaaaccattctgttttctgctgtaaatttgactactctagaaccttcacggtgaagtgaaataattcaatctttgtccttgccaaagctagcattacctgccttcatttcagttttcggtaaatgcagaatgatatactagttatcatctgtggcagagaatgacatccctagatcaggaatccaggcctggttgtgtctctgacaaaagcccccttctccacactacagttgaagttgattgctgaaaccagttagggaattacactagcccctgtattttcagagggagaccttccttctacccttgaaccagaacccagactactccatggtctctgtgcatgcttgtttggccattcagggtctgggtatacagctgtagtgatcaggaatagcagactatgacagcagcttgaattaaatttgtcagctgattaggtggattaattacctcaatgacaagctccttttttgtgtctctccttccataaaggcacacagaaaggattagagtttggagtctggagtcttagatgatcttagatgattcttactgctgtaggtggttagggtgaggttagggttacattgagcttttcaaaattcactttagttaatctgtttctgtgtcttgtagtgagatttttatttatgcaagttggttggaattttgttctgatagtaatgtggctgttccagagatggggactaggacaacgaacatggttatgttgtgctctctaaaaatctgatagcccacattgcctatatactaaagtcagtgtgttgaatagtatgtttggtaaactgccatttttcctttttttttgtgatgcttgagattgaacatggatttgtttttattttatgtgtatgggtgttgggtctgcatatgtgtctgtataccaagtgtatgcagtgcccaaggaggccagaagatgatgtcagattccctagacaactggagtttcagatagttgtgagctgccatgtgggtggtgggagttgaacccaggtcctctgaagaatagctagtgctcttaaccattgagccttttccagaccttggatagaccttggataggtctgcatggctatttagaccagacttctttttagcattccagataactacttgtttcagtggacacatcattattggaaaatgttttcatttactgaattaaaacttttttttttttttttttttgaggaagggttttactatatagctaagactgtcttagaacttggggtacttctcctcagcttggagttacaagaaggatcactgatgatgccaggcttcatagaccagttttaaggcatttactaaacatactacgaggctcgaggatttgggtatatttaatcaggcaaagaagcaggcatatgaaaagttgtgactaggccaggaccttgaaagcatagacagatgacgtctaacctagcattgttgggtcaagagggcatccttgaatttggctaggcctaaacataagccaggaaaatgaaatttgggaagccacagtagaggcagagacaggactattcaaggcagaaagaactgtaattggagcattggtaatgatgttatatgagacttttgtttacttattgtattaggtacagttgtaggcatttaacatttgttagcttcttctctgagaggtagctaaaagtattgccatcctgtaggtgaggaaagcatcttgggaattaaatgaatttctcaagattctcaggtcaagtgtaaagcctcagctgagtggatgtggtgataacagaattggcaaggtagggagaatagaagtcagctcacagaagggtactgttgaccctgtgaaggactttggaccgtatcttgaggtaagggggtctatggtctatgagtttgcatcatttggaggctatctctggtaatattctaggggaatagactgagagctagagcactactggtagagaccagttagccaggtgcagtatcattggcccaagattctggtgtttcaggtgacagaaatcacagagtatgtatacatgaaaaaagggaaccaaataagattgttggaatggagaatatggaaagaagcacattttaatctatcatatagaagagtttggggtgtgtgtgtatgtgtgtgatttgtttctctatgtaatagctctggctgtcctggaactcactctgtagaccaggttgaccttgaactcacagagatccacctgcctctgtctccctagtgctgggattataggcatgtgctaccagtgtccggctagatgaggttttaagtgggaaccaaaacagggaatatagaagggaagggtgagaatttatctgctttcattaatctctgttatagataccagttctgtatcagagctggggacattggtgaagggaggtgggggttagtttgacttcaaaacctaatttggctaaaccagcagttctcaacctgtgggtcatgaccatcagaaatatgtcttaggaactgagacaccactagaagcaaaattagttatgaagtagcaacgaaaataattttatggttgggatcaccacagtatgaggaactgtattaaagggtcaaagtgttaccaaggttgagaacagctggcctaaactgagtgatgcaaactttggaaaaatatttccctttggaaagggaaatattagttgctaggcatgtgggttctgtacagctgcaaaggaagactgcttttgttaagccaggataatcttgtattttctctagtcggcgtcttgtaacactcgtgttccagtgtgccgctctgtaagtattgtcaccttagctaggcaccagaaaaccaaaatatgagtaaaggagcccagggaagtccctttctagaagagcaacagatcttagtgactttgatagaacaacagggtggagaaaggagagggttgtgggattgagcaggacaggacagggtgggattgcattggggactgtttttattagggataggagtctatcctaatagacctgttttccagatttcctattaggtggcaaatgttcaggtttgttcatctgaataactaagatcccttctagcagtaacattttatgactaaataatttagacactatatctccaggagaggtatttcccttccagacatcttaggcagtcttaggggttaggtaggggaggaaagatagcaagagggctttcacatgagtgctttgtgttaaggagagaaaaggaaaatttgagatctttgttcaggatagatagttagggcagagagagtcgtaaattggatgattagtagcctgaggattatctggtctgtttctttgatcctaagtgggttggctagaacaggctatttttattcactgatgttgttttcttcataaagtaatctaggaggttcctgagagtctataaaagcccaaagactagagataggaagtggtgacagaacaagattggaggtcccttcctactctccctccctcttttcccttaggtaaatacacaggactatgcccaggcaccattgttaacttttctcattgtttccatggcacttcctttttcttccatgttaagtttcttgtcatttcataattgcttttgtagtaaaacatgtgaggtaccttttgggaggaaaaaaaaggaagatgagatgtggtccctttttttagtttccatttcttagaagaacacttggagctgtctactgtgtcctgctctggatggaagggtaagaagtcagggttgtggctgaatacataggtttcccagagggcgtgtgtatttggaatgttgagagttgatgaaagtgcaaatctagcagtcctgtcaccctgtctagtgagttccattaggtttaaaaacatatctgatgggcttttgatgctgtctgaactcagtgttagttggaattacttaggactgcaattttagtctttcttctgaaaaacaaggtgatagtactagataatcttttaattttgttatttactattgtgggtatatataggagtatgatgtatgtgtgtcagttggtgtgtctgtgtcatgctcgagtgtggtgtttttttttttttgttgttgttgttttttgagacagggtttctctgtagctttggagcctatcctggcactcactctggagaccaggctggcctcgaacccacagagacccgcctgcctctgcctcctgagtgctgggattaaaggcatgtgccaacaacgcctggcccaagtttggtggtcttttgggagttgattctttccttttaccctgggttctgaggatccgaccatgtcatcaggctttgcattgcaggtactttgacttgctaagccatctagctgaatctggaataggatctccccccaccccacccccccaacagtatttcctctgtgtagctttggctgtcctgtaacccgaagagatcttaatctcctggatgctgggattaaaggtgtttgccaccactgcctggcttgcaatagataatctttttttttttttaatttttaaaatttatttagcatgtatacagtattctgcctgtgtttctcttcatgccagaagagggcatcagatctcattacagatggttgtgagccaccatgtggttgctgggaattgaactcaggacctttgtaacaacagccagtgcttttaacctctgagccatctctccagcccagaatagataatcttaaatgttgtttctactacagttttatggaagtggcttaagaatttttctctggaaggagaaaggggtttacctaaagcattaaatatctcagggttaaattctggggtcatcaaataaaccttttactatataaaccgatggatattgcttttaaagagtagacaaattgctgaagaaaatcctaggttaatttaccaaattatctgctgagtttcattataatcttggagctgaagccctgtgggcaaacttgggagcctaagactatatggaacattaaatttaaatatgtgacagactgtctgaaaaatcacataatgaaagtagaaacagtaggagtggaaaatactagctccaaaacatttcttgttgttgtttttgtttttttttgtttttttttttgtttttgagacagggtctctgcagctctggctgtcctggaccttactaggcagagtgctgtcctctaactcacagttccatttgcctctatctcctcagtgctgggattaaaggtgtgtgcagccatgcctagcccccaagcaaagagtttttgcagagcttttagccttatgacgtaagtacccttatttcaagacacctggtccttgaaatggcatctatagagaataagtagttcagtttgtcaagccaagaatgattgctttactccaaatacatattctcttttagaaggccaagttgagcagcctaatgtttttggccaggctttcttcatcctggagacatttatttggtatttagctgtctcttgtttattgaagattttggtaagcttagttaaaggtgatgtttgcatggcttctcttcatctgtttgtctagtttgctttataattctttgtgctagtgaaagcaagcccggcagtagatttaaaagggtcatttctgtaactcatcgttttgtaggtctaggtttcccttgtgttgggtctgatcacgctatactgggaagtcaaatgttgcctgttccccctaacagaccattttcaggctttggactttgttcttctagataactgtaggctaccactgaggaatggtgctgtcaatataatgagggatgtgcatgagtcattggaacacaagagtaacttttcttaaaaccttataatctcaccttaaattaatttttcaaatcaattaaaatagcctttttatagttagggttgtaaatgaggttagtgttaccttgatggtgtaatacaattacgtttggaacagcctatcttccatccctgtgctcatctggtcattgcggcaatttgtgtgcctactgtgtattctccttgtagaatttctatctgcagttatttttcaatactggagggaaacaggtaaacaaatcagggtagctagatggcttactggataaggaaatttaccgctgagcctgatgacccaagtttgattcctgggatccacatgtggtaaagagccaacccctgcagattgtcctttgacctccacatgagctttatggtgagaacactgtgcacacactccctaaataaaactgaaaacaatggccatttgtattccattcctacccattcctacctgtgcttctcttggcccagatacctgagttgtgagttcatactggcattagcataattgatgctaataattcatagcataccactatgaaagaaggctttggttgtctgacttctaatgtattgatctgtttttggtattttcttcccttctccttttcttctgcatgctatccagttgttgatctttcctgtccaatgtgcccggtccctagcaagtaaagtcaagaacattagtgtaagggagaacactgatcttgttgaaggtgcagccatccacctagcaccttctctaattcttatatcacttctttggctgacttccagaaagatctttcagagataagattaagaagaaataaggcccggctgttggtggcacacacctttaatcccagcacttggaaggcagaggcaggcagatctctgagttcgagaccagcctggtcagccaggacagcccccaaagccacagagaaaccctgtcttggggggagggggagaaagaataaggagaaataagtttcatattgaattactactttcttttgatataaataagtctctgttttgcttgcagtagatatttgagttgtgttttttggaattcgatcaatttgtagtttgctgattctcaaagctcatcactgtgactgccttctttaagtgctttgctgcattgagtcctaaaaaatggaaatagaaatgaagggaacatggaggtttccttcatcttgaagaactcctttctcttaagggagaaaagtcacttagggtaatttattgtggtcatgatttttttcaacaatttagccttgcctgaggggtttaaaggactaagtgggttcttgagatagttcagtgggtaactgtacaagcctggtatcctaaattccattgccatcatgtaaaggtttaaggagagaaccagcttctagaactctctctcccctccctgtcccccccccccagccccctccagagatggcttagtggctaagaatactgttgttcttatagaagaccaggtttgattcccagcacccacatgtggttcacagctgtctgtaaatccagttccaggggattcagtgccctcttttggccttttcgggcaccagcatgaaagtggtacacaagcatgcaggcaaaatactcataaaatacaataataaaataattaaaaaattaatatttaaaatactttttttttccaaaaaagattaagaagtatgcctttgccaacccttgaagattagggataatgttaagggagagggccaaactagagcctattgttgaggtgctctttggtcttcagtgatgttatattctctgtgggggagataaaaaagctgataatgaggtaggtagtgtattgggcagtgaaacttgggacaggaagctctactcttttatggcactagcaaactggagaaataatttttccttactgagcttcactttctcatttataagatggggttaatattctgtatcttgctttccttaccatgtaaggggaaaattagctaatgttactaaaagtacacaaagtaaaatggtgaggcagttttacttcatgagtcatttgtcagaagtaataggtaactggcaagggtttccataggaagggaagtctttgggctgcagtggtgagcaagagtatctgagccagtctctagaatcaagagacatcccttgaatgtctgagctggtttggtcttgtagtataaggatagtaactattgtttgagttgttcctcatttctaatattctgactgatttctgcttacaattgattaaatgccagtatttctgtttctggactatattacccagactccacccagaagcaacatgcaaacaccttttctcagttaaaggaaatcctttctttccttctacttttacagtttctattcatcacccaggaagtcagggcaggaacctgaaggcaggaactgatgcagaggccacagaggaacttatcagcttgctcccattgacttgctcatcccgatttcttttctgctttttagttccaggagagctagggctacacaaagagaaacactgtctcaaaaatccaaaaatatatattatgttttgtgtatgactgttttgcttgcgtgtatatgtatgtgcactatgtgtattcatggagatcagaagagagtaaaggactttcagatggttatggaccacgtgtgttcagaggatctgaatatagattctctgcaagaataacaagtgcttttttttaactgctgagccatctctccagccccaagcctgctttcttacctatctaggaccacctgcacagagtagcatcacccagtgagctgggccctctttcatcagtcattaatcaagactgcctataggtccgtgtagatattttctcagttaagattccttatgtattaaagggttcattttcttttaaagctgaggaggaaaggaaacactgacacctaaagactccagtctctcagctcacctattacttgtgtatttgctcagggaaaaatgaccatttctttgttagcttttatcctgccagtggaaccttgctgggtgtttattttctgtagttttaccaaatcactttgaaggctggcatgaacatagatcatgtcttagagcctttcttctttgttctataagcaaatattagaaaatgtaccttaaattaacctggttgggggaaataaatggtcctggttgttccctaatggtaaacattagtcagctcttgagtctgtgtctgtagggcgtttgttaaaagaatctgggggtgttggagcttccactagagacattgatcagagggctattaggctcctggtcaattcgaatatttgttggaaaagatctggcctgggttctgaatctgccctcattttaatagctgcagtgaattatgtgtctgttttgtaattatgccatatgtggtaccatgtatttgtgttagtagagctgatactcaaagctatgtgctaagttttaaaaatctttttagatctactacagtctttagaggtagattctattgagtcctataaacctctctctctctctctctctctctctctctctctctctctcacacacacacagtgtgtgtgtgtgtgtgtgagagagagagagagagagagaggtagagaggtagagagagagagagagtgtttctgtgaccataaatatagctagggaaacctagtaaataaaaaacaaatgtttttctagcaataaaccttcctgggattgagttactatttcatgggtaactaatctcttgctgggcaaaggtgtttttgcttttgtggaaatattgaagaaatccagaggcagtagaataatggagtgccatcctgcttcaagggatagcaaacatttaggtgggacagtgttgactcccagtggcatctcatgaggacagttttgttattttgcaaagaaaagaaaattttagttgtgaactacagagaagcagcccctttgagagaaaacagttcctttaacgttggggacaaccaagtgttttctcttctagatctcttcacagcatcttattctctagatcagagatgaaaaactggcagctgctgggttggtaggccctgagtacatgttgtctttgacctgaggtgttttatttggagttagaccctgagatagccctgctatgtgtgttacaagagtgactggtaacatgtgaagagagattttgttgttgttagtatacaaagtaatgaatgggtttcattatttcatttccatacatatgttgtaatttattcttttatttttattttattttattttatttttttcgagacagggtttctctgtgtagttttaggagtaatttattcttatcccactttcctactgcctttccttatgctctctgccctccttttactggtccttgtcctttccccaaaatccccatttcttctttcttctctcccctgtctctttccagtcccttccagtaagatctcttggtttttctacttttaacacacacacacacacacacacacacacacacacacacacacaccctccctacctctctgtctttatataagataaaatgtggttatttcactcacttatccaaacgtaatgctctccagttgtagccattttttactgcaaatgttatgattttgcctttcttttgtgactgaataaaattctattgtatggccaggcggtggagtggaggtgcacactctgaatcacttggcagaggcaagtgggtctcggtgagttcgagaccatcatggtctacaaaatgagttccagaacagccaggactgttacacagagaaaccctgtcttgaaaaacaaaacaagacaaacaaattaagaaaaattccattgtgtgtatgtagcacattttctttatccatctatcagtagttaggctagttccatttcctggctaattttagttgttcaccaataaacatggatgctcaagtatctttgtattatgttaactttgggtgcatatctaagagtgatatagcttggtggttctatttttaagttttttttctacccctatggaacctccatgctgactctttgtcaattattattattggaacctttcaggaagtcattgtctctgcccatatcttgaagtcaaactatgtttttagagctggaatttgttcgaacacggcacctacagaggatctattggagctggagttgcataccctggggagctgtctgatacataggtgctgggatagagagtagcaggggctggtgtctgatatgaaccataaacagttctagttacaatagtgggtctaggccctggctgttcttcagaagggttcattcctttgatcctccaccaggcttcctgtcttgtgattctttattaccttgcctgtgtatattttcacatggcttttttgggaccctgtgactgtgttctttgggaaatcttctgcagcatcaccctaacatggaagaatccttgaatttacaactaacaatcttcatatttcttcttaatgcttccatatgggtaagcttctttagatagtaatgtatttgttctcaagtttgttagagccacactcaactacttgtctcattgataaccaagctgtgtatcagttgctctttttgtttttcttccttttatctttgaaacttggtggattcattttgttacccgtttgacctctgatttgctttattgccaaggataatcctgaactttttatttttttcttgcctctactaagtgcaaagctaggattatgggtgtgtctgcctgaactctttaacattaaagagacttcagctaggtgtcgtgctgctgaatctcctgagcgtaaatgaggtctctttattttatgaggaaccttcagctgccactattgactagtcagtttgtgtcctgacctgtcataagacttggcaaaaaatagcaaattagccaaggcttagtaggtcttatctttgttaaagttgcatttcttatccctaatatttgtaaactgggtgtgtatagtggtggaagtaggactgatgccatgattaaagctggttttcttaggagttagtaccttgttctttttctcgtagttgcaaatcctatttgtgaaaagtaggcatcttctgcgcaagagccttcttgaagttattgtaacatggtcattgtaggtacctgacaaaaaggctgtcaatatgtgtgtgtaactcagaaggtatttaagttcttacgatgctagtttctcagattgaggcacatgattgcatgtgggaagtatgtaaaatcacaacatacccaaagtgtcgatgcatttggatttcttttgtgatttagaactggcaattttaaagttcttttttgaaacagaatctcttttgcatagccctggctgtcctagaacagaccaggctggccttgaactcacagagatccacttgtctctgcctcttggcttttggtattataggcatgctccagtatgcccagctaaagtttgctcttaatatcaatcacacagaaagggatctgtgtgtgtgttgctgaggatctgacttaaggcctgatcatgctttatcatgctttgtcactgaaccaaacaagcccctaccccattcctaaattgtatgagtggacaataaattggtgtgcattttttaaaaaatgcatgtgtatgtgcacacacatgtacgccttgtatatatgaggttgcatgcatgctatagatttatgtggaaacagtcagtttccttctactgggtgtacagggtttcagagaggtgtggtgacaaacacctagtcactgagctgccaccagcctaagaaagatgtggttttttgttttaaggttaaatgagaagacatcaaagaaacagtagattatagaaagccttctgatcttccagtggatctaatgttactagatcttgacaattaaaagaatagttggaaaaaattttaaaagaacagtctgaatagctctagttggcctggaattccctgtgtagatcaagggtggctttgaactcacacagatccacctccagtgtctgttcctgagtactggaattaaaagagtgttttaccttgctgcctaattttaaaaagcatgatctaatttttaacattggcaactaatctgggatttttaaactggatttgtatggatcagacataccttttttagtgacctataaaatatattactggtctgggaaggaagtagactttggacatggctaaataggtaatggtgtcagaaatggcaggcaattactggaaccctcggccagaagcctggctctggctttgaacacttgcccccacaaagagaaaaatgacataaaacttataaaagacaaaaaaaaaatgtacagttttgttgcaaactggagacaaagccattctcaacttaatctgttttccccagacaaatttctaaattttatagaaaagataaagccaggaaataggcttatgtagatttatgtggttctcattgagttgaagggggacaggtgtcagtcactagagttctaattctatttggttttcgtgtaacctactcagggcttctgagcaggctgtctctgctgtcagcgtcatgtttcttacagggagccggggctgagaaagccaattaacatttttttctttttagttttgaatgagttccattatagaaggaagctaagagacttgataagttaggacagattgttacattaaacgtcaccctcttgcaggctgtcctcgcttcttgtgcatgcagtgacacttcttcctaagccccacatcccacactccttacactgaggtgcaactattctcttccttgatttttgtctatcttcctaccttttttttctcactgtttaaggaatttttattaaagcaagaattttataatccaaattatgttttccttgctcagtccatcagttatacaagttgaaacagaactgatatcccaagctattccacagtaaagaattacaaaattaaagaaaggaatgctttaaatttttatactttgctgaaaattcttttcccagggtctataaaacattaatttgtttttatattttactattttttttgtattttttgttattttaaatcaagtaatcaggactagcattgtttgctagagctggcatttgcttggtacttaaggttcaaagtttcctttccttttttatttattttatattttgcaatgttttttcataatatttaaatttttcgatttttagatattttttccttcggtgaagcacgagtttcttttcgtggtccctgataaatttaaacagatggaactccagcggcactgttcagatgtttagatatttttttctccggtgaagcacgagtttcttttcgtggtccctgatcagtttaaacagatggaactccagcggcactgttcactgccttctgggcagcctcttttgcttggtgggcctgtagtacagctatagcttcatcaacctttgagcggagagactcgggagactcaagcatgtgcagtagttctgggttatcaatctccaacagcatgccagtgattttaccagccagagtggggtgcatggcttgaataagaggaaacaaccattcacccaacatttgcttttgctcttgaggaggggcagatgccaacatggaagcagttaaaggttcttgaccttgcacatgaacagcaggctgttgcatggtaacttgtggctgtgcattaagttgttgctgggggttgtggactcccgcagcatatttatactggggaacggtggggacagcaggcgtggctgcagcagcagcagctacaggacgtggacccatggtccgtgttgaagtgttagcaacatgctatgttgacatgactcatggaacctgtgaggatgctggtctcatagtactaaatggtggtctaggagcagctgggcggatagcaccgggcatattctggaatggatgaggtctggcaccctgagcagtccagcgaggacttgctcttagttgagcaatttggctaggaggatagtatgcagcacggttctgagtctgtgggatggctgccatgaagtaacctgaaggaggtgctggctggtaggggttgatcacagggttgggcacagcttgcacacttgccattctctgcatatgctggttagtaaggtgagcctggcgctcttctttgcgctgagctaaagctacatagaatggctttgtggccacaattctgccattcatttccgtaactgctttagtggcttcttcaggagatgagaaacacaaaaccaaacgctttgctgcgaccaccctccatcataacctttgcactggtgattgtaccaaatggagaaaactcgttccggagacgttcatcatcaagatttttcacataaatgttaacaccctagtatctggtgatcctatcttgcttcatttgctcaaatttgcgcttaagctctgtctgttgttccatttttttctgagctcgaccaacataaatctgtttaccattgagttcctttccattcatctcatccacagctttctgtgcatcttcatgcttctcaaagcttacaaatccaaatcctttggattttccactttcatctgtcattactttcacatttaaggcaggcccaaacttgccgaagagatccttaaggcgctcgtcatccatgtcttctccaaagttcttgatgtaaatgttagtgaaatcctttgccctggctccaagctctgcttctcgttccttgcgagacttaaatcgtccaacaaacacttcggtcatttagaagcatcccattcattttctcaatagctctttctacagcttcctgtgtttcagagtgtacaaatccatagcctttggagccattttcatcacaaaccaccttacatgagaggatgtttccaaatgcagagactctaatatccttcatccattgtacctagcagactttttaaaattaaattttttttctccctgagataggatctcactttagccatcaatggcctggacctagcagacatttgaatttaaaaaaaattagggctttttgtttgtttgttttctttattttattttattagttcaaattgggaacaagcttgcctcagatgtcaatcccttctccctctccctcccctcccccccaacatcccatctgcccctagccattccccctctattccccaggcagggtgtaaggccctcaaaaggggctccccaaagtctaccacatcatcctgggccaggcctaggccctactccatgtgtccaggtcaagagagcatcccttcacaagggatgggctctcaaaatcccttgtttttttttaagaccttacatatttaatacagtgcgttacctctgtacaaatggaaaaaaaaattaagttcaacatttctagaccaatatggctgttaatttttgtacaatgccaactcaacacagtaaactgggatttgttttcttgttttgtttttctgtgtaacagctctggctgtcctggaactcactttgtagacccggttgaccttgaactcactgtgatccacctgcctctgcctcaagtgctggtactaaaggcatttgacaccactgcccggccaaaaactagtttttaaaagaaatgcctactgataacttagtggattgcttgtcatttatttagtagattgtggactatttgtgacatcttttggaaataaggtagaggaaacagaagattgggttagaatagcagttttcaacttgtgggttgtgacccctttggaagtccccttcgacaggggtgccatatcagatagcctgcatatcagatatttgcattcataattagcaaaattatagttaggaagtagcaacaaaaataattttatagttggggggggtcaccacaacatgagatgtttgggtcgaaacattaggaaggttgaaaactacagcactatgtagatcaggctggccttgaactcatatgcctgtacttcccaagtgctggaattaaattcattggccaccacagttgactgctttaggagtaatttaaccccccccccccaaatctcactagtctccagtgggcagggcatttcaagacattcaatagaggctgtctagagcctgacctgtcagaagtgttgcagtggttcctaattagaaatggatctatacgggcttgtagccagagctggggagactcttgattaccatgaaatggatctggtaattgttagcaccgtggttctgaaagtgtggtcctctcctgggatcagtggcaggcagcactgccctgaacaaattgtgaaaaggttggtgaacttgtgttctccattattttctcctcacttaataaaatcatgctagtgcctagttacagaccacttcctcagatagaagtcacttatttaatacttcataaatgttaaatactagggtaagctcttttgcatgtttatgtcttctaagttaccagagtaggttagaaaaggaaatggaagctgagagaagtgaaataataaatacttgactattcattgttacatagcatattgtctgtggtgatgaccaacattcgagacataattgtaattccaactactgaattactttgtttttttaaaaatcagggcccacctttaccctcataaatattcaattgaagatcaggtcctgtccttgtagcccttcaaagactggagaaatttcttttaaaaccagtggtaatatagttattagtggggagctctgcttgcttttgctttctcatttccttttcaaagtctaaggaatgagcaggctctaatgggagagatcagtcatcatttgggatcaatggaaggtcttttagagcgatgctgaattgaaggaggagaaaaggactgtggatatttctatgcattgagaacctgaaggcttagcatgttcagttacctatgttgtcagaccctgttactcctattgttggtcattcaacaaatattggatgagtgttgtcctatgtattaagacttttgctagtgctaaggattcctagataacttcacaatctagcatcatttagggaaggatgccaaccatagtagatggtgtgtgctctttaataggatcatgtataagcatgaaaatgggctttcctggggaacataaatgatttgtgctgttgttttttttttttttttttttgagataatctcatgtagtccaggttggccccaaactctcagtcctcctatcctacttgccaagttctgggataacaagagtatgctacctgttttgttttaggattttacttattttatgagcattggtgttttgtatgtgtgtctgtgtgagggaatcagattccctggaactggagttagatttgttagctgctatgtgggtatagggaattaaatgaggatcctctggaagaacagccagtcctcttaactgctgagccatctctccatccccatagctctcattctcattctctatcttctcccctttatcttccccctcccccctctttctcttttcctttttggaactcttcatgtagaccaggctgacctcgaactcacagatctgcctgtctctgctttctgagtgctgagatttaaaggtgtgtgctgccatgccaggctttacttgcgatttgaaggtaaagtgaagagttaaggtagggaaggaaccagcacaaacaaaagcataaagttatattcaagaacccagggtaaagaagtgcacattagagtagttcttcatatagcaaatcagattgagcccttgccctttgccacctttctactgtagcctttggatggcagtgatgtaggactataggtggtggaagaattagatctgtaaggaggtaccatttgaaatttctagaattctgtagagggaaggcggaaggaaactgaaaaccagcaatcttttggaccaagcctgccagaggtgctgagttcttcacagtgatttgaaaattctggcctgggcaaattggttggtttttctggcaaaatcccattggctccatatagtctgcccccccccatgctttttaaaaaagaaattaatgggatctgttcaaaatacttctgaaatgaaattacatttttaactctaattaccctaattaaaacttgacagccataatcctgaaatgacagatatagtaagtaccccaggcctgtgacaggctcatttacccagatgaaatgtcgttttgttttggcttaggaaaattcttttatttttcttatcagcagcttagtctttgctcccatagctttaccaagctaggggagctgtagtggtgggctacaggcttaccctggacataatctcagtagaggtgccatcaagatggttgttaccacatatatctaagtctttttcttcagttcaaattggacttaagcctttgaatgaaattctctgctttgaaggtgaaggaaatggcatttgttagaaacctgttgatctggggatagaccttgttcttgggtaagtttatgactagtattaagggcactttaaccatctgtggtgatgaacacctgtaaatccttgcactcaggaggctggtggcaagaagatcaccaattcaaggctagtcaagacctgtttgaaaggcaagcaaacaaaaccatcaacagtttgaggttaggaacaagaaagtctgaaaatagaagtcttttcatatatctccaattcctctaactttgtacaggcttgatggttgcctagtcttaactaattacttggctagccttaaaatatcttggggtgaggactaggtccaagtccatgaagctaactgaagaattggttgataccaagtcaagaattctagaatcagaagccttttaaagtcaatagacactggctgctatgttttatgctaattactagagagatagttgagtaagacacagtccctgatcctgagaaccttagaattgtggtgaggcagcaataggtaaggaatagtcattcatatatgacaaattattaagggcagaataaaccttattcagtgttagaaagtctcagtgccttatgtatatgaggtactgaaatgagtacataaatatttcagatacaggttctgctttgaagagtgcctagtaaattaagacatgtagacttgtgaaaagttgattgtaacactcaacatgtagatgatatctgctggacagatttacctggagaagagaggctggtcaggaaagtgagaaaggattagtttttccactggtcatccacaaagatttaccacagcctttttcattgagcttgtccttgaatagggagtaatggaggaatgaagaaaaacactgtaggtgttaggaaatagcttgaccaaagttaggatctgtcaggtgataggtgtctgatgtgatttgagtagtatacagggaaagggtgtggtagatgatgagggtaaagtttaaactttatccggacagcaaggcaatcaaattcattgagacagtgtaagactgagatggcagtgtatatggtgtattctctgatagatgtgattggagacaagtagattagttaaaacaagggtcagtaaattacgatcatagggtgatacacagccactgacccacagaacctatgtatgtttttgcatttcagtgatatgttgaatactacagagattttgctgctgtagccctcaaagcctaacagtctagctgtccagccctacacagaaaagattgacagatacctgagttaggtaattatatagggtatgtaagaaaaaataaatgttagaactaagtctgaaataggttggtaatactgaaagaagttagcaatgcgatttaacaggtaacacttgtcctatctgcctctcaagtttgtaaaaaggcatttgatatgtaggcaagtactggtgtgcttttattagttgcatagctttggtccagtcatctaactgctcagaggcccagatgaatataatgtagtaagtaggataaagagaagcctcaccagcttgattcttccttacggatttttgtcttgttttgattttggagacagggtttctctgtgtagctctggctatcttggaactcattctgtagaccaggctggcctcaaacttacagagatctgcctgcctctgcctcctgagtgctgggattaaaggcctgtaccaccacatgtgctgctcagctcttagggaattttgtaagtcatctagttggaaagacagatgtcctagaaaatggagttatgttaggggttgtgggtgtgttgtcacctttaatccaagcactcgggaggcagaggcaggtggacctctcttgagttcaaggccagcctagtctatgtagtaagttccaggccagacagggatacacaatgaggttccatctctgaaaaaaaacaaaaaccaaaacaaaacaaaaaaattatgaaggtgaaaaaaaattccctcctaccctaaggcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggtcatccacaaagatttaccacagcctttttcattgagcttgtccttgaatagggagtaatggaggaatgaagaaaaacactgtaggtgttaggaaatagcttgaccaaagttaggatctgtcaggtgataggtgtctgatgtgatttgagtagtatacagggaaagggtgtggtagatgatgagggtaaagtttaaactttatccggacagcaaggcaatcaaattcattgagacagtgtaagactgagatggcagtgtatatggtgtattctctgatagatgtgattggagacaagtagattagttaaaacaagggtcagtaaattacgatcatagggtgatacacagccactgacccacagaacctatgtatgtttttgcatttcagtgatatgttgaatactacagagattttgctgctgtagccctcaaagcctaacagtctagctgtccagccctacacagaaaagattgacagatacctgagttaggtaattatatagggtatgtaagaaaaaataaatgttagaactaagtctgaaataggttggtaatactgaaagaagttagcaatgcgatttaacaggtaacacttgtcctatctgcctctcaagtttgtaaaaaggcatttgatatgtaggcaagtactggtgtgcttttattagttgcatagctttggtccagtcatctaactgctcagaggcccagatgaatataatgtagtaagtaggataaagagaagcctcaccagcttgattcttccttacggatttttgtcttgttttgattttggagacagggtttctctgtgtagctctggctatcttggaactcattctgtagaccaggctggcctcaaacttacagagatctgcctgcctctgcctcctgagtgctgggattaaaggcctgtaccaccacatgtgctgctcagctcttagggaattttgtaagtcatctagttggaaagacagatgtcctagaaaatggagttatgttaggggttgtgggtgtgttgtcacctttaatccaagcactcgggaggcagaggcagggggacctctcttggggacaaggccagcctagtctatgtagtaagttccaggccagacagggatacatagtgagacccttcctcaagaagaaattgggcaaagggtttggtgactgtgtctggaggtataggggaagtaatttcaaaataccacataccctttctcttcattaattcagacgtttgttgtagccatattgaatttgtttctatccttcaactgccaaaaaccaaaggctggatttatccctagccagaaacaagcataagcacaaatgtcaatttgtattgttagcatcagttgtcagtcatctgacaggagaacctcagttgaagaattctctacatcagattggtttgtggtagattgtcttattaattgatgcaggagggatcagctcaccaaaagctctaccaccactagacaggtggtcctgggctttttaagaaagcaattacatatgagccagagggagagtcagcaagcagcattcctctatggttctggccctgactttcctcagtgatgaattgtgacctggaagtataaccaaataaatccttttctcctctgtattgcttgcatttagtcagtgttttatcatagcaacagaagaagactagctcaacctacaaaggagcagcttaagataggaagagttcattttgcttaacatttgaaggtacatcccatcatggaaaggttggactgtggaagtggctctgagcagagcagttagagaatgtaagtagtaaccatactaagcctcagggcccacatcacagtgaccctcatctatctaggctccaccttctgaagattcccaaaatccccctaaacaatgtcatcagatggggaggatcattgtgaggttttttttatattttaagaaagagggctggagagatggctcagcggttaagagcaccgactgctcttccaaaggtcctgagttcaattcccagcaaccacatggtggctcacaaccatccgttatgagatctggtgccctcttctggtgtgcagatatacatggaagcagaatgttgtatacataataattaaataaataaataaataaataaataaaatcttttagaaagaaagaaagaaatatagccaggcattggtggcacacacctttaatcccagcactggggaagcagaggcaggaggatctctctgagttcaaggccagcctgtgagttcaaggccagcctggtctacaaagcgagttccaggataggctccaaaactacacagagaaaaaggacctgtcaccaaaaaaaaaaaaaaaaaaaaaaaaaaaaaaaaaaaaaagggggggaggacgcagaggaagaggaaatatagccaggcatgatggtgcaggcctttaatctcagcacttgggaggcataggcaggtgtatctctgagttcaaggccaatgtgatctacaaagcaaaatccaggctagccagggaatgttagacagagaactcccaccaggagagggaggaggaaagagtgagggagaaatatcttctgataacttcaaaagcctttgtaagtccaaagtctcatttgagccatgagccatgctctcagctgtgagcacttgtgattattaaaaagcaaagttataagtgtagattcttccagtttgagatgtagcatggtcctcttggattacaactgctgcttctattcttgatgggcaggaaacacttccctaagtgaacttaggacaggtttgcccagagttctcaataggttgagtccttcactcaaggtacctttcttattgtcccagtgcagagcatgaggtttctgtttaacagtgctaatattttttcttttattattattttttaaagatttatttattttatgtgtgagtgttctgtttgcttgtacacctttatgccagaagagggcatcagatcgcactatagatggttgtgagtcaccatgtggttgctgggacttgaactcaggacctctggaagagcagccagtgatcttaaccactgagccatctctccagccccaagcgctaatattttcaacaattgacagctactttgttcacattaccatgttctcaacttgaaccagattcaagctccttttctcactttccagcttttttgctttactcattgctttttcttgctgtaaacctagataaatgcagcaagcaataaccataccacagcctgactgttctactgtcatgaaatttcttccaccaaattagtctgttacctttaaattcaccatattcatgtcttttaggacatagaatgcagccagtttctttaccagagtgaaacttaatggtttctagtccattcctgatggagatagctagtcttcgttgtcaatttgggatttagaatcaccatgggacatatctctgggtttgtttataaaggtgtttcagaaagacttaacagcagagaagaatgtggatggcatgatttcataggctgaggtcccagacctaagcactagtgtcaatctcaaccctgcctgctgattatggttgtagtgtgtccagttgcctcatgctcctgctgcagtgtctaccttgaaactttgaaccaaaataaattcttcaaaaccagaaaaatctatttatttatttatggaatgaagaatgggaatgggggcaggacacacatgtgcccatagtgcaagtgtggaggtgagaagcagctttgtggagttgattcctgtttccacttttatgttggttctgagcattgaattttgagttatcaggcttatgtgtcaaatgccttgcctactgaatcatttggcctgccctctattcttgcatttgtggttttctttccagtctttggagctcaatttagaatagccctccacagtgacccattaagctctgcttatagtgttcagttcttttttccatgtgggtcagatttaatgcagcaatgattccttttggtttttaaaaaagattatttttatttatgtgtacatctatgtgtgtgtatgcacatatgcatgcgggcacccgtaaaggctagacgagggtgttgcatctcctggagttgaggttataggtggctgtgaagctgcccattatgggtgatgggaactataagtctggttctccagaagatctcttaactgttgagacattgcctcaggtttttttttttttttcctgttagtttttgtattgctgtcaccaagtagctgacaaaaaagtaacttcagggagaagaggtatattttggctcatggttttagattacagtcgatcatggtggatatctttgtctcttgtaagttccagtatagacggcctcttttggaacttgggatttctcttcaaggggtcagtgtcaaaacacatcctttttcgttttaaccttttcctaaagttcccctctcctttcagtgtagaggatgagtttatgcatgcaccttcatgtgcttgaaatccaccacctttaactgtgaagactgtagccatctgtaactgttcttaatagtcaaacttcattttatagttttatcatttggtgtagacagtcattttcagtgattaactcattgagagaaaagaaatggcagaggagatagacaagaaaacaagagtgatcaaagccctgccaccagtttgggctcaaaacgacatctattttcttgctatttcagctgtattttgctgccttttcttataagagcttgggataggaatgaactcagtggaaatggtagcaaatagatagcctttggagactggccattggggaagcctggccttgggtttagagatgtgcttttgtcttaggaaggacctaagttcaaggtagctgacaaaggggctttcaaatggacctgaacctatttaagtagtaaagcctcatggtcagctgactgtgtcctgaatgtggctgcaagagctccacaagatcttgtcctacagctagcctagtgtaagataacagggagaaaaggttaattcccaggccttatcaggaggggaagaaatcacaatttgtttgataacaggatttaaatttttcagtctcaatttgaaatgataaagctatggtagctagaacgaggaaagaaatgagtctcaagctaaaaagcaaagcacccctctcaacaaaaacaaaaaagccaagctttgttaaattatataacttatcccacttaaaccctttaaccattttcttcttggcatagtatttgtaaacctggagctttttcctagagactgtgtccttttcactgaccatggctggctctgagctatagtgtctttcagttatctgctttacctttgactctgatctgtgaagcttctgatagtttcttcattcatttgggaacaagcagcctgagatcctactgtagatacgctagtgtcttactatgcctttgattccttcttcctttaagctaatctccccttcatacggatgacctgaatcccaactaaaatccacacatggtctttttaatttttgtgcaactgttctattcttctgtggtattaatttggtggagtttatcattgtctcagatcctggtctttcaccccaggccttggtttcttgggttgagtctacatctacataacattgttattgctagttcaaaactgacacgaacttaacctgcaatctcagcctccacattgagggaacaccacattgattctacatcacaaagtctagataatgtggaaagcacactggttgtggataaggaggcttattgtggccttgccatagactttgattttggacagaaggtctgacctgtcctttcaggtggtacagtctttctagtgcctgctctcattagggataggaaagctatcttctgtgtagtctcagttgcacagagcactgtctggcatgagccttggtgtgttggtttctgattgtaaagcctgagattcccctcctagctctagaggggggaggggaaccatccaactgtctcattagcatggagaaaagaaaacagtaattacttgtgcctcccttgataattctgcagggttggttcttagggaaggaggaggggaaaactggagacagcttcagctgaggaaggagaaatgttcttacttagttcccagaatatgcaaaagcaagaatttgcacatctgttgtattcttaggacattcctccaggcaggctggagactgcctggattgaatttcaatttttgtggcatatattaatgttcttactgtctgacattaagttactggctatgctaggtattctgatatttgcctttgttaaggagtagggtgggattttgctggagcactttgtgacctggctgaatttttatgctatgagatcttcttgaagcaacacaacatttggatttatttttctagtcaaggttaggtgtctttgtaaatgggaggagtcttggaaaacgacaagactgtagtgttctgtcaagtctaagaaaagcaggactcagaaggcttgaaagtgggaagttaggaacagctggaacagaattagcaaatcaatatgcaagcttggctatggacaatgactgtttgctctgtgttaatctttcattccctgtgtggacagttgtgagcccagaagtactgattgtagcagaagcggattggagaatgtgctgtgctggtgagcgttgctggggggagcttggagctagtaggttcttctgttgctgttctcctgctctggttgctactccaggccaagagaacaactcccccccccccccccccccccccccccccccctccccccccccccctcctcctctcccctcaggaagatagcttcagtacctcctttcatgtaaccttcctttagactttggaaatcatttattgtaaacaaccaaggcatctgtaaagacatgtttaaaaatttgtttacaaatgtaggaaatgattgtttctgtcaggtttatattcttctaccccttgaagtattccctttttccctccctgggccttttgcttgattagtctgcttttgctgtccaggttccaatgttcccttagcctctaggtatatattcctgctttccttatacttttgtagaatctgttccctatgtttagatggaatgctctaaatagcatggcctaagggaggagtaattctcttcagccttaacttggcagttaattgggccatagtaatgtggttcccaggaatacacatccaggacacagtaaatgctgattctcagaaaggtctccatatcattatataaggtactttgatcagatatttcaggacaggcctacttgttaataatctcaacccttagaatatagtctccagaggctgaggctggagaaatggcttagtgattgagtgactgacaatagttgctactctgaaagagtaaggcccctagcacccacatccagtggctcacaactacctaaaactgttgcttcaggggatttgatgttttctggcctccctgggtactgcacacatttgacattcattcacacaaacccacacagaaacacataaaagaaaacaaaaaatcatactcctttatgattttatttttgtgtgttaagatttatttttcttatttttatttatgcatgtttatgtttgtgtgagggaatgccctgtgtatgcaggtgtccacaggggccagaagagggctttggagctgcatttgacaagtgtttatgagatagatgtctgatgtgggtgtttggaaacaaacaggtcctctggaagagcagcaactaaaactcttaatcactgagccatctctttagtccccaaataaaaccaatctttaattgttggtggtgggagggcgtaagatgacttagagggtaaaggaacttgctgtcaagtgtgacacctgagtttaatacctgggacccacagggtgagaggagggaactgattcctctaagttgtcgaagatatggcccagtatggtaaaagcctgtgttgtggtttgaaagttaagtgtcccttgtaaattcatgtatttgaatactttgtcctgagctggtggtgctgttttggaagggagtagacacttttggatctggagcctacctagaggaagcaggttactgtgggacagcttgaggttgaatagcctagccccatttccagtctgtcctctgcttcctgacatggtgtgctgttatgcccccctctctctccatggtggactatctctcttctccttacttctttctaatattgacttactaatttagttgtgtatgtatgagtgtgtgtaggtcagacttacaaccctcttggtaattcagttctcttctgcctttttggtcctttggatgaaactcagatggtcaggctcagtgaagtgcctttatccactgaaccattttgccagtcctgtatcccttatctgtctctctacctttctttttttttttaaattaactttttttatgtgtgagaatgttttgcttgtgtgtatgtctgtgtatcatatgtgtgccaggttcctgcttaagtcagaagaaggttttggacatgagttatggatgtgtgtgtgttacagtgtgggtattaggaattgaaccttggtcctctgcaagaaaagtgtgcttaattaacctgagccatctcttcagtttcctctatcccatcttaaaaccaaagtagactcttcctcccataagtgacttttaaaaaatatttattttcattttatgtgtctttgtctgcatgtatgtatgtgtatgtgcccggtgcctgcagaggccagaataaaagggcattggatcacctgcaactggttgtaaggtgtcttgtgggtggcaggaactaaacactggtcctgtaagagcagcagcaaagtgcttttaactgctgagctttctcttaagtggctttttgtcaggtgtttgtcacagaaaagtaggtaagtggttatagcaaagtaactaatgtacctttgtgaactccttatgtaacaataggctgacagctggctggtctacagaggcttctttagtcctggcacttgggaggcagaaacaaggggatctctgtgggttcaaagccagcctggtctacaaagtgagttccatgaaagtcaggactgttacacagaaaaaccctatcttgaaaaatcaaaaacaggggctggagagatggctcagaggttatataagcactggctgctcttccagaggtcctgagttcaattcccagcaactacatggtggctcacagccatctgtaatgagatctggtgccctcttctggtctgcagggttacatgcagacagaatacctgtacatatgataaataaattaaaaaaaaaaaaaaagaaaaatcaaaaacaagcaaagaaccaaaccaaacaccaaaaaaaaaaaaagtgtcaaaaacaataggctgacagcaccacaaccaggggtgggtgtggcgcatatctatgcctaaccagggttggaaagtggaggcaggaggatcaggagttgagggccatccttggttacataatgaattgaaacccagcctgagcttcaagagatcctgtctcaaaaaataagtaagatttatgtaatgggtcattacggctattcttttaaaaagaaaagcccttggtttttcccactgtgctctcatggcatcctttgaaaggctttttgtgccattttatttaaagtagattctactcttactccttgttttatttcgtgactgtttaaattttcttcctaatactcaacatggtctgaaatgatagaaaccaggattcaaaatgtgtaagggttaagacccttgacagacctcttttctctgttacaggtgagccctgattctagagacagctgctgctgaccctgtaaccctaaggactaagtagctggctaaactcattcttggtacaggtgagtgagggtattcaggcagatttgggtaaccatgggctaagataaagggtaactagtttagggattcttttcagcttttgtactgatatcttacaattaatatttttttttctaggtactggaatattctagagatgggaataatctaccagtgagccctaggtagcctactggcctgggaggaggattgaggtcactttcttggagttgccataagcatgtttgggatcatttgtcagaaaaagggcttcctttcttcttgcttttgtcagtgccgggggcaagggcaaatataaggacctagagcctatatccccattggggatcttcttgacttcagcctatttgacctactaagccccaggttagcataaggaaatcttaagttttctctgttctgcataatgtgatcatgaatggataaggatgcagtgatccagcagagctgtgtgaaatgggtgaggatgcagtgatccagcagagctgtgcgaaatgggtgcggatgcagcgctccagcagagctgtgtgaaatgggtaaggatgcggtgatccagcagagctgtgtgaaatgagtaaggattgcagtgatccagcagagctgtgtgaaatgagtaaggattgcagtgatccagcagagctgtgtgaaatgagtaaggattgcagtgatccagcagagctgtgtgaaatgagtaaggattgcagtgatccagcagagctgtgtgaaatgagtaaggattgcagtgatccagcagagctgtgtgaaatgagtaaggattgcagtgatccagcagagctgtgtgaaatgagtaaggattgcagtgatccagcagagctgtgtgaaatgagtaaggattgcagtgatccagcagagctgtgtgaaatgggtgaggatgcagtgatccagcagagctgtgtgaaatggatgaggatgcagtgatccagcagagccgtgtgaaatgagtaaggattgcagtgatccagcagagctgtgtgaaatgagtgttaagcagcccagagaggaagggaaatcaccacattgagaatttattatgctagctttccctttatgtagacaactacattttatagacgaagacattgagacaaacaatctaggaacccataaagctgatcttagaatcagctcactgtgaataccattatgatgtgacagacttttccaggagctgcttgaagtttccctggaattatgctgtttctcttctctctctctctctctctttttttttttttaggaaatttaaggagctagccctcctcagagatttgagttatttgaggagcccagtaggacagggaggaattagggttcattgtgatcaattatatgatcaatgaggatcagagagtgcaagacaggaagatcttaagcaggaagtagcttatctaactaactggaagaagaaaatacccagaagtgaagggatctaagaagttgggctgacaggagttaggaacctggacagctgggttgacattgggaaacagagtttctctgtgtagccctggctgttctggaactcactctgtagaccaggttggcttcaaattcccagagatcagcctgcctctgagtcctgggattaaaggcctgagatacctgaatttttaatcttatctctcagtgtgcctttggacagtcttcattaccccaatttgtaaaattgttacttcctgcttccctgcagcattgtgtgtgtgtgtgtgtgtgtgtgtgtgtgtgtgtgtgtgcgcgcgcgcgcgcgcgtgcgcgtgcgcgctcgctcgctcactcacacacaggactgaacctagggcattgtatttgtttggcaagcactctactatcaacctaaatccctatctccctgccatatgtgtgtacaaccattcagtaatgatgtagagaaccaaatgagaaatctaagaaaagttttgcaaattaatatgtaacatgaatgaaagaagaaaagtcagacctgtttgttatcctactccccaaagttaagagtgagggttttccttagggtatctctgctgtaagtctttccctgcatctttctctcttctcctgcaggacctacccagagcagtgctttatcacagggaaatgggttccagagacaggtgacagaacatccaactctggcagttgtagtttgcagcatgtgctctgcagagttaggtttaaattcactcaggtgcccaggcttcaaggcctctgctggagggtagatcttaaagcagctctttttaagaacccatttcagcactaaccagctcagtgcattgtttcctgttgcctcagcagaatagcctactaccacacccactggtagtgaaagaaagggtacctatgttgaaatttcatcattccagttttcctactgtcttgcttttttcccctggccagtgatttaagctgtttttttttttttttcttctctgtctacttgaagggtcacaaagggatagaatgctcacatggtgctcttaaatttagtgttgacaagttccagtttttcttcatactctgaatcttcaggtttttattaatacctttgtgtcttggtgatctaagttccacagattctgatctttccatggcttgtgtgccaaggttagaacttactgccctatgaaaacatttcactgttacttaaaaatgtgagtggtttcttgtaaataagtgtgtaatatacagatgtatgtataatagtttatttatctagcagtctcatgttcctagagcccaactgaaaaacagggaagcaaagcattgctatccttaagccttgcataataacatattttaacatgttattataagcttagctgtcttgcttttaaacttctgcaggtaaaagtaaaagcaatgagaaaagctgtgctaatattaatgacaactagaggtaagaggcgaaagctggcagtaatgaaaagggtgaaagaaaaatgatactatatttaaaataatagactggacggcattgaaatagaggtgggtaacagccctacaaataaatacctgtgtgctttactaagataggggtggaacttagggaaataggtaagttctgaggtttttattagaaaagttatttgtgggatatactatattactaggcacagagtctatgtaaatttatttcattttcatagcaacttgagaggtatgtggtgatattcttgttttataaattgctgagacctagagaaggcatgtaggcattaattggaagagctaagcttagaatatagtagaatctgggtatagagacccaagacttttctgttatacttgggtttgggtttttagattgttgtcttttcaggcttttggatcaataatagctccccctttttgttcatcccactatataaattttctgttttgaagaaattattattcatctgcttagtgcttattggtattttctatgcagcatgcatggtttcaggttttgagatctaacagtgaataaaatagtttgatctcagccgggcagtggtggcacatgcctttgatcccagcactggggaggcagaggtagatggatctctggccaggtctgttaaacagagaaaccctgtctccaaaaacaaaaagaaaaatagtttgatctcatgtttacatattagtggaagaaagcagaagaatgaataaatacgaagaaaaataatgtaggataagggaataaggagaactatagattaaagaaggtctgtctgagaaaaataaggttggtgcagaagctgaagtattgaactttgtatcttaaactaacattctaggcacaaggattcagcaaggtcagaagtcctgaaacaagcatattggttgtgtttgaagaaaaaggtgtccttagtgtatagagaggaagtaagcaaaggggacattagactatgcagaagttgtcttaaagagtaaggtcaggttatgtaagattttgagaggaatgttgtgattaactagctatctttaaaaaaaaaaaaatgttctgcatggcggtggtggcacacactttttattaattccagtactcggtaggcggaggcaggtggatctctgtgagttcgaagccagcctggtcaacagagtgaattccaagacagccagggctatacaaagaaaccctgtctcaagaaaaggaaaaaaatcaggctggagagatggctcagaggttaagagcactgactgctcttccggaggtcctgagttcaattcccagcaactacatggtggctcgaaaccatcagttatgagatctggtgccctcttctggtgtgcagatatacatgaaaacagaatgttgtgtacataataaataaaatctttaaaaaagaaaaaagaaaagaaaaatccctctgaccgactccaacagctactacctctcactctttatgtagtgtggaattgcaaagaactgtgagagcattaccttgttccagttctcatttatttattttacaatgtagtattcagtcttaatctgtgggtggcttactataagaaaattctcttttactcttaggtttactgagaggttttattatgactggttatattctgtcaacatggtattacattgatttttcagatgctaaaccaaccttgtgttcctagaataaatcccactttgtagtaatgtataattatttttttttaatgcagtgttgattttattttttaagatttatttattatgtatgcagtgttctgtctgcatgtatgcttgcagaccagaagagggcaccagatctcattacagatggttgtgagccaccatgtggttgctgggaattgaactcaggacctctggaagagcagtcagtgctcctaacctctgagccatctctccagcccatgtataattatttttatgtgatattagattcgattgtatttttgtgatgtctttgtttggctttggtatcagaataataatagtggcctcaaaggctaaacgagaagtagaatcatggtcttttctgtagtctgaaaatttggaaagaattatattatttctttagaagtttgatagaatttaccactgaagccatgtggacatgaaattttcctaaaaatcttagttactaattcattatagaaatgttttagttttttcttacagtaatgcttagattttctatttcctttttagtcacttgataatttgtgatttctagacacttgtttataagttgatttgttcacttaaaattatttgtagtattttcttatattctttttatataaaatcagcagagcatctgtgtgcctggttttagtaatttgtaacctcatcttttctttgtattggtttatacattttataattttttttcaaaaactcaatttgtagtttcattagtttgttgttgtgaattgatgttctcactttaatctttattatttcccaacctctgtttgctttatatactttgtttctctctttctggttcttaaggcttaggccactgatttaaaattgtatttatttattattactatgtgtatgtgtaccctaacccttttcttgtttcattaaaactaaaaatgttctttcttactttcttactgaaacagtgggcagagacgaagacagctaagcaagagagaggtactaataggtcctatagatcagatcagttagaggtcacttctagaaacattggtggcagggagtcctgagcctaagaatattgccaagaaatcagagtctaagtcaggaaattggaaacttcagttcaggaaaccaaggtctgttagtagctgtggtgctaggattatgtgataaagctaggcctagtggcacaggtttataattccagctacttaggagggcgaagcaaggggttctcggcctgctctggctgttgaaatgcagtgtcagcctggacacttccatagaccttttctcaaaaaagaaagaaaaaggaaggaaggaaggacggacggatggaggcacaggtcacttcattttagcttcaaaactcagttgtgatagacagattcttgagattggtaagagatactgtagggaatttacctaatggaggttaggtggagggagtggtaaaacctattttaaaagaccccattaacacaaagcagagagcaaagagctgggcctagtggtaaagagctatagtcctagctactccagaggctgagcctggaggggaaggaatagcatacaagagtctctgtgctcctttgggggtgtgtgtggctggcatttttgttttatcttgagtttctattcttttacctttatcaccattcccttatatttctgcagttagctgagtctatcaagagctaccttagtgcctagggcaagagacaaaagactctaaagacatcactgttgggggtaagttagtgtttctttctcactcttcaaccctgaaactatatgacattaaaggagtcagatttgtactaagatttgagtctttgctgtgacgtttatctcctgtgtgactgacttcactgacctgtagttttcctcatctgcaaagttagatcttattgtggttattgtgatgctaatggaggatggaaaaataccaggcctgcctaattggagggagtctgtcactggatataccgtctttagactgtatatcctagggccccatattcactttttctctgcttcctgtctgccgtggtgtaaactctgccatattttcctttaccaagataccaaccttaaatcaaaaagcttcttcctccttgaaagataaagaagggagtaggaagagccttggtatagagtagggttcacctatcagtgactgaaataaattccccaaccatgtgttacataattagatttaaaaaagggaacctggtagttcaggttctgaacttttagtctggccaacctcaggaaaccaattcattcctgagtttcactttcctcagctataggaggaacaaaggcagaaagcccattatcttgttcttagctgtttgtattctggcttttgcccttggttgagaggatttcatctgtgagaaggcttttcttttctttgtatttatgtgtatgtggtgtatatgccaggtgggaactggagttgtgagctgcctgatgtgggtgctgggaaccaaacccaggtcctctgcaagagcagcaagcactatttagtacggaatcatctttctagccccatgagaaagcttttcaagagttgaggtttaggggctggagagatgacactggctgcttttcagaggtcttaggctctctttgtcctctgctcatattaggcacacaagaggtacgtagatactacatgcagggaaaacacctgtatacgggttttttaaaaaaggctttgtcagccggacgttggtgccacatgcctttaatcccagcaccctggaggcagaggcaggcggattgctgtgagttcgaggccagcctcgtctccagagtgagtgccaggatagggtccaaactacacagagaaaccctgtcttgaaaaacaacaaaacaaaaaaaggctttgtctagctgggtgttggtggcacacgcctttaatcccagcacttgagaggcagagacaggtcaggtggatctctgtgagttcgagactagcctggtctgcaagagctagttctaggacagcctccaaagccacagagaaacgctgttttgaaaaaccacaaacaaataaataaataaataaataaataaataaataaatagtaagtcacttgctcagaccagattccagatctcttctgtctcattccagggttttcttttctagagtcaaaccacatatatgtaaacaaagcatttcagctttcctaacatctccatcaacagccttcttaggtcccctgtggtgtgtgtcaataatacaggctgtacttgtttgatttactttggctggtacaagatccagatgctttcagaatagcacaacagattctctaaatctgcccattcccaatgtgctgcactctatcaactggctggggcttgtccctgagtcctccctacctgtcatgtcagtcacattgttttcttttggtagtttgccctttccctcttaaattttttaaaaaattatttctgtgcataggtgtatgcatgttattagaaataagtttgcaaagaaagagactaccattctagtaagagtctgagcaaggcaaaattttacttttggtctttgtcatgggaataaactattttactttagccattgtcttagaactaccactttgtgcagaaagtaagttgctagttttccgctcttaactcatgctacccccacacttaaaactagcagctcattctcctctctagtcaatgttcagaattgtttgaagcctggctccattcttaacctccacggaagcaattggaagagaattgagatttgaagttgactatttctggatttgagccctaggaatagcgtctccgttttccctagttaattaccagctaatattagataggagtctttaggtactcattgcttcgagcatgtgactctacagctaattcaacagttaatttttaaaaatttctttattagcatatactatatattatattgagttttatgacatatccatgcatgtatataatcatatatttaaccatattcacgtcctatcactattttgtttccttcctacttttgctgatctccttcctcttcttaagcagttttcctactccaaccccattgtcaaatcagagtaggattactacaggagcgtagttgagaatacaggcaacatagtgtggctacaccactggagaaacttggaaaagttggaagttggaaaacttaaaaaggaagcatacacacacacacacagaggtacacatataaatacatatataatacatataaacacatggagagaagtcctgtagaagttagaattctgcatgtatctactgtataattgttgtctagtccccctccccctctttgcaatgtaaatttgaggtcttctgcttttcttatcagagccctaaaattcagcctcatagccatttggaaacctgatttgattatgactgctcacatcaaaacatttctgatgattgaacagtagtaatccaactggcagtgtgccacttggagagagcaggatgggaaatgattatctcgatgaatggtaactgttaatccatgactagaaatgctccacaaatcaactaaagatttctaagacaggatttggggtgggtgggtttctaatcttataatttaaattaacccatttctattaatttactttctgcctcgtggctttattacctttactctgcccatgttgctttcctgcttcctccatgtctggctgatgactcctcccaactctgcccttcttcttcccagtgttctctctgccctgaaagtttttcctagctattggccatttagatttttattaaaccaattacaatgaaatatcttcacagtgtaaaggaatattccaaaacataaacagttgcacattttcccatatacttgtataaaagacagtgaattgacaagtgttcaaatgttgctgaggctgcttagaggccacctctgccattctgaacatcatttcaagtgtctaaacaagattattgtaatttgatagaacctctcttcataattacacagattcctatatgcgtgtttactaattatgttcctaggttagcactttccctcttaagaacatcagtttttatgcctaataatgatagtactgtttataactacttttgagattgtggtagtttttagatatgaaggtatggtggggggtcattccctgcctccccagtgatttgatgctttggttctctagatggcactattgaggtgcttagaccatgaaggtgatgacttcatcaatgggttaaaactacccatagattcatactaaatgggcttttagaaagtaggcctgattggacgatgtaggtcaattaagacatgattttgaaggataaatctggtccctctgtcttggcttactcgatgccatgaggtgaacagcctcgttggtctcaggcccatagcagtggagctcgttagccacggaccgaaaccatagacaaaaataaatctttgttccctttagttgactttctcaaatgatttgtcattgtgataggtaaactaacagattagtatgagagttcaaaatacttcgtaaatatcataatctacaaaacttgcttgagtaaaggctaaggcatactgatctgtttttgttagctatttgaagactccaggagatggcagtaaaatcagttcttctctaaccacccttatcctaagaaatgctgggtctcattttcttcctgccgtttcatggcccagaggacttgggtaataaaagagcccctcaggtcatgcatgagtaaccaggacagttatctagcagataccaagggcagggcaggtagctcaggaagcagtagctgatgaacaaaaggctttctctctgttcctaataaattggtccttggagatcctagctttgaaattctaattgacacaggaggaaaagattcattagactctggactcattaaaatgctctgctgctcaccttcaatttattcttggcagttggtcagaaggaattaactaaactgacagtctgtgatgctgctgacagcagagtcctgtgtgcttggtggtactgggggctgtgggtgttggttgtgcctcctatattctatggaatatatagatggtttgaaaagcacatcatccctaggacttcatgagtctaaatctcacatatctttagcactgaaaggaccttctgagatcataagggataactcatttacagatggtccagagaatgactagtgcttgctctagtcttaagatcttaagatcaccaagcaatttaatggtgaaattatggtcacatagcctgactttgggccaagaatatttttcccttggacccattttgaattttagagtcagaatgtcattaattcagttatgaaacatattattttatttatgtgtatgcacattttgccttcatggtgcttgaagagaccagaagagggcatagaattatagacggttgggagctgccatgtgtatgctggaatttgaatccagatctctgggggtagggtggggggaaaatcagtgtttttaaccacttagccatctctccagctcttaaaatataatacacattttgtgtgccaagattctgtgacagaatacgcatggggttggaggaggatagaagaagggagtcatgtacctttcccatattagaaattagaacgaccaccacatggactgaagagatgactcagttggtaaagtacttgccatgtaagcatgaggaccccaagtttagttccccaaaccagagttaaaaaaataccttgctggttgaggccagcctgatctacagagaaatttcaggacatcaagggctacatagagaaaccttgtctcaaaaaaacaaaccccccccccccatttaaaaaaaaaaaagaccttgctgggcatggtggccatgcctttaattgtgggcaggggtaggcagatctctgttaggtcaaggccatccaggtctacataacagcttcaggtcactcaaggctacatagtgagactgtctcaaaaaggctataagtaagtaaataaataaaagttgattgtggtggcatgtccttataatctcaatgctagggaagtggagatgggtaggtcctgtggttcattgaccaacttggtgagatgccctgtttgaaaaaggcaaacaagatgggcagcttttgaagaatgacatctaagattgacttctggttgccacactcacctgtgtacaaccatttgcatacatacgtttattcacacctacatggacacatttcacagaaagaatgacaaacaaaagaaaaaggaatgattactgctaatgaggaatttgttcactagagaagcatatagggaatatgaaggctataggcccagcgcaactggcttctgtatcccaggtttgagattagatatagttccttcattaagaatacagacttagactatgtcactgttcccagctagggcctagattcaagaatgctttgctatagtttttggcattcgttgctaaaagcatgggagaacagatggccatctcagcagtttggatcatgagggtatgatctgagacagagctagaagatacattgagagctctatacctagttactgctgtttaggcccctcccaagctgttctctatctcagaacaaagcaaaattagctaactctatttctcatctctagtcttccactcccacccctatcccttctcctcgtcccatatatttatgctgtactgacctcagtgtaagggctactgggagctgctatcctaaatgaccctttgaacctatttcccaggcatgtctcaagatgaagctcatgagtctggtcccacagcccttatggcatctactttatttagatcattctagctgtaggcctcctaccaggctctcttctcatccactcccctgttttcattcccaactcttaagaattagataatctgcttagtatgactgcttagcttaaagaataatcaatactgagaggaaactgatggttcttgattatttaaaatgctgttaaattttagtaagtattaaggtgcacatgacttggaatccctgaaagagtgtcataatttttttttttaaagatttatttattatgtgtacagtgttcggcaccaaatctcattacagatggttgtaagccaccatgtcgttgctgggaattgaactcagaaccaggcagtgctcttaacctctgagccatctctccagccccgagtgtcataaattttagaaaaagaaaagataacaatatttatttatgtcatttcagaaatttcttaatattctgacttttgtacctgtttttgtctttgagctatagagaaactctgagggaaataatgcaaggatttctgtttctgcttggcatttatggaagcctagggaaggctagtgaccatttaataatcttaatggcagagcccaaatagaaataagatgtggaagataaatggttatagacttgaaacaaggcattcatcactttctagtcatgtgactctgaagaagttattaaacttctctgagcctgtttctttctgtgtcatatgaggaaaacatgcacttaatatagttgctttatgttagcaccctacagaagaaatataagaactcattattgttcctatctcagtggtttttttcccagagatttattcaacttgcttttaattttgtatgtacacttgtgcagcaacatgtgcatgtgtgtgtgtgtgtgtgtgggggggtggctcaaggctgtaagtctaacatgtactgctgagacatctccaaccccttatggtttggttttttgtttgtttttattttgtttgtgagacagggtctcactcaaggttggccttgatcttccttctggcctctatttcagtgctttaaatatgtattatttattgattttttttgaaaatagattctttttctcatatgatatattctgattataattttccctccctctgctcttcccagttcctgcccatcttccctcccctccagatccactccctttctgtttctcattagaaaagaacaggcttctaagaggtaacaaccaaatgtgacaaaatgatgtaaaagctatcttattgaagtcagacatggcaacccgaaaggaggaaaagagtcccaagagcaggaacaggagtcagagacccacttgttctcaacagttaggcgttccttaaaaatactaggctaatatctataatatatatgtaggggacctagtgtagacccatgtaggctctatgcttgctgcttcactctctgtgagtttatgtgcaccttgcttagttgatttagtagagggccttgttctcctggtatcacccatcccctctggctcttaaaatctttccatccctcttctgcaggattccctgagtgctgacgggagggatttgatggacctccaatttaggaccttgacaacccccaccccacccctgctgaaggtctctgcatttggttcccttctgctgccagggaaagtctctctgatgatgactggacaaggcaccgatctttgagtatagcagaatattattaggaatcattttactaatgttttttgttttagagagccatcgtgtttgattttacccctaggtctctgggctatctagtctctagttcttggttagccaagcagtgtcaggtgtgagttcctttagacattggttggctacttccgcaagttctgtgccaccattgccctagtatattttgcaggtaggacagattgtaggtcaaaggttttgtggctgggctggtatccatgtttcctttcagtagcctgcagagtaccttcctacaccagagaatagaacgtggtggtgaagcttcgtgtaggcaccagctcaacctaccgatgtcagtgagttgtgtgggtggtgttcttggcagctgacagtttgctaagaacaaccatttgtcttaacaacagtttgagttgtttgagggtttccttgggactcctttaaccaccaactcaagtgaatttcaacccagtccagccaccgaagtcttgcctgacaagaaatggccagttgagtcctcatcaggatcaccttcagagactccaggacgtttccactgcagtaggtttccacacgaccctccaaatgcaccccatttcatctcttccctgcacttcctccctctaccccatctctccccctttccctgatctccatcccagtccacctataaaatttattctattttcccctcccaggagatccatgtgttccctcagacctcttctctctgcccaaccactgggtctatggattgtagattggttatcatttccttaatggcttctttatcaaaaatcaggtgtccatgtgtgtggatttatgtttaggtcttcagttcaattccattgatcaacttgtctatttagctttgtaatacaacttgaaatcaggaatggctgaatgtccagcagttctttgattgtttattattgttttaaatatcctgggttttttgtttttccatatgaagttgagaattgtcctttcaaggtccagaaagaattgtgttggaattttgatggggattgctttgaatctgtagattgctttaggtaggatggccatatttactatgttaatcctactgatctttgagtatgggagatctttccaacctctgatatcttcagtttctttcttcaaaaacttaaaatttttattttacaaatctttcatatggttggttagagttaccccaagatattacatacgattttaggctattgtgaaaggtgttatttccctgatttctttctcagtcaagtccttttgtcatttgtataggtaattgatttttttctgaattaatcttgtatgcagtcacttgaaaagtgtttatcagctgtaggagtgtcacctacactttcaggtagaactttcaggattgcttatgtatacaatcatatcatctgcaaatagtgaaactttgacttcttcctttccaatttgtatcccctaactctccttcagttgtcttactgctctagctagaactttgagaactatattgaatagataaggagagagtccttatgagggaaattggtttgtaaatttcttgtcctgtccctgattttagtggaattgctttgagtttctctgtatttaattcgatgttggctataggcttgctgtaaattgcctttattatatttaggtatgtcctttatatccgtaatttcctcagaatgtttatcatgaagaggtattggatttttgtcaaaggcgttttctgtatctaatgagatgatcatgtgattttactctttaagtttgtttatatggtggattacatttactgatttttcatattgaaaaatgaaaaattgaaccatccctgcatctctgggattatggtgaacaatctttttgatgtgttcttggattcgatttgcaagtattttattgagtatttttgcatctatgttcatgagggaaattggtttgtaaatttctttgttgagtctttatgtggtttgggtatcagggtaattgtggcctcttagagtgaattgcgcagctgggcaagggtgcatgcctttgctcccagcactcaggaggcagaggtaggctgatctctgtgagttcaaggccagcctggtctacaaagtcagttctaggatagtcaggaccgttaagcagacaacctgtcttgagaaaaacaaaacaaaataaacaacaaacaaaaattatgcagtgttccctctgtttctattttgtgtaataatttgaggagtgttgacattagttcttctttcagagtcttgtaaagttctgccctagaacatctggtcctggggtgaatttgttcttttgtttgtttgtttgagataggtttttccagacttgcctgtcctggaatctcattctgtagaccagactagccttgaactcaagagatcctcctgcctctgcctcctaaatgctggggtcagaggtatgtgccaacaacatcttgaggttgggagacttaatggctgcttctaggggttatagctctatttaaattgtttatctgatcttgagttatctttgtaagtgatgcctatcaagaaaattacccatttcttttagattatctgatatggtggtataggtttttaaagtatgtccttaatgattttctgggtttccttggtatctgttgttatgtctccctctttaacttttgattttgttaatttgaatattctctccctgacttttagtttgaacaaggatttgtctattttgttgatttttctcaaaaaaagacaccatatttcatttatatgtttttttttttttgtagtttcgtttctattttattgatttcatctcagtttgattatttcttgaggtctactccttttgggtggcttacttttttgttcaggtatgctctaagttcctggtatgagatatccttttttttttttttcttttccagacagggtttctctgtgtagctttggagcctgtcctggcactcactctgtagaccaggctggcctcaaactcacagagatacgcctgcctctgcctcccgagtgctgggattaaaggtgtgcgccaccaacgcccggctgaggtatccaatttttttacgagggcatttacagtaaactttcctactttcactgtgtcccataaatttggatatgctatatattcattttcatttctttatttttgtcttgatccacttttcatttagtagaattgttctgtttccatgagtttgcaagctttctgttgtttctgttgatacctagctttaatctgtggtggcctgataggaagcaggaagttatttaaattttcttgtatctgttgagacttctttgtgtccaaatatgtggacagttttggggagagttccatgaggtgcagagaagaaagtatatccttttgtgtttgggtgaaatgttctgtaaatatctgttaggtccattatttctctgtttggcttttgtccggatggcctttctgttggtggggtgaaggattgaagtctcgcactggcagtgcatgaggctcaatatgtggtttaaggtttagtagtatttcttgtacaaacttgggtgctctttgtgtttgggcatagatgttaagaattgaaatatcatcttggtggatttttcttttgagtatatggtgtccccccctctctttttaaaagattttatttatttatttcttatgtatacaatattctgcttccatgtatatctgcacaccagaagagggcaccagatctcataacagatggttgtgagccaccatgtggttgctgggaattgaactcaggacctctggaagagcagtcagtgctcctaacctctgagccatctctccagcccctccccatctcttttgattagttttgtttgaagtctgttttgttagatattaaaatggcaataccagcttgcttgttaggttcatttgcttgaaatatctttttccaaccctttacccttaggtgatagacccttgatgttgaagtgtgtttcttggatgcagcagaagaatggatccagtttttcatatccattgtgtcagtctgtgtcttttggttggggaattgagaccattggtattgtaatgtatcaatgatcaatgattgttgagtcctgttattttggtggtggtggtggtggtggtggtggtatgttgtgtgcttcccttttgatatcactggtgagattatttcctatgttttcatgggagtagttaacctccttaggttggagttctccttctagatactgtttaaatttgacttttccatggaatatattgttttctccatctgtagtgattcaaggttattctggataacagtagtctgagctggcatctgtggtctcttagaatctgtaggacatctgtccaggcccttctggtttttcttgtaggttttaatactctttctttgttctgtacgtttggtgttttgattactatgtactgaagggtctttctttcccagtccaatctatttggtgttctgcttgcttcttgtacccgtataggcatctccttcttaggttgggcctttgagttgaatttcttctccttcctctatacctattattttggtttggtcttttcatagtgtcccagacttcattgatgttttgtgttgggggtttttagagttgatactatctttgactaacatatctatttcctctatcatatcttcaacacatgagattctctcttccatctcttgtattctgttggtgaagcttgcctctgtagttcttgttcatattcctacttttcatttctagaattccctcagttttttttgtttttgtttttgttttgttttgtttttatcaattccattcccaattttgggtcttggacaattttatttatttccttatactgtattttcttgtgtttctttaagggatttattaatgtcccctttaaggagctctgtcatatttataaaggctgttttaaggtcttttttttttctgcttcagccatgttggaatattcaggacctgctgtggtaggatagctgggctctagcagagactttatttccctggatgttattgtgttttatttatttattttttattttatgtgcattggtgttttgccagcatgtctgtatgagggtgttggatcctctggaactggagttacacacagttgtgagctgggaattgaatctgggtcctctggaagagcagccggtgctcataaccactgagccatccctccagcccctattgattgtgtttttatgttggtgtctcagtatctggggttggaatgattataggtctggggatcatttctggatttgtctttgttgggtggttgtattgttccttggtttctgcttctttggatttttagagagtatgatggcagtttgttgcctgttttcctggcatgctcagctggtgtattcacagggaatgcctgctggtgttggaggatgggatactgggatgagatgggggaaggaaggttggaagagagtttctgtgatcctttgggaacatgctcagctaggaaagggagaccacagcaggtttcctgctaaagagctggggatgagactgggggaattggatattaggatccataggagagatgtgcccttcagcttactagttgccctgtgagaagtggcctttggttagccaggggtgcctgctggagttgggttcctggacaaagcaacacatggaggggagtgagggtaggagggcagtctatggggtcacaggagatacaggtggtagagaaggaacaccagggatgagactgggggagtggctctgcggaacagagaaggtctgtgggcagactacctggttttcaggtatgacctatggtttaccagggagtgtctgctggagtgggggctgtgatacagcaacaaattgggggagaaaggtttggagtggttgaagaagctgaccagaagtggatgagatggaatgtcaatgcctttttgatattaggcccttttctgaggaatggtcacttgtgtgttaaagggcattactttccattgaagaattaccgtagaactgatcttgtcttgctcctttgttttcagggtcagttgggtaaggtttgcaattgagcttttagacccactatttatataaagatgggggaagggggcaactcctggaccgcagcattatttgtactgcattatccttctttttctaaccagcagatgttgaaattatagacatttctgtagtcactaatcaaagcacattgtttgagcatcaagctttctgttttgacttgtttgttccagcaggaaaataagtaaacagcagatttaatggccaccaaatgtttccaaacagttgaagaactagagtgtcctggtcaagtaattagctttgtgtctgcaaagttgcatctaactcacaggctgttttctctcatcattgtcttgcctcttcttctgccctactaagctgcagagtgaaggacttgggcacattcggttcttcctgtaagtttagattgcatcccagggatctcggggttccaccatgcagttcccaatgcagaccactctggtatcaataattataacaccactaatttgaagagaatctaccagttttctgctcctttgttgtcatctctatcatgaagtttatagggtatgtgttttgggggtcccatctgccccagcccccaggatttcactgtgtagctctgactatcctagagctctgtgtatagacaaattggcccaaactcacagagatctacctgcatctgcccatcaaatgcagggattaaaagtatacaccactatgcccatctgttcttttggatttttatccagcccccgggagaagttgctttggcagttggtggggactgtctttatagttttctaagtctcctaggttggatttagttagcaggtcagtggtggcatacacctttaatcccagaatttgtttgagaccaacctggtctacaaagtgactttcaggacacccaaggctacacagagaaaccaaaaaaccaaaacaaaatctcccttatattgtctctccaaagaagagactcttgaaagcctttttttccctttaattttaaatttattttaattggtttccttgcacatatgtatgtgtgaggttgtagggttttctagaactggagttacagagaattgtgagctgctgtatggatgctgggaattaaacttggaccctttgaaagggaagtcaatactctcaaccactgagccaggtctctagctccaaacctatcttatgttcaaaaaagcccagtgacattgaagttattatttcccttgtcataggccattgaggtgggaaaaggggtgatcatttataggtaggtttactgttatcacacagttgcttagtatgagcttgatgtgtggttaatgtccaagaagtggttagtagttggaaaaccattacagtctgaggaatgaagttcatgccttttaaaaacaatgctttgtatttgtttctccatggtgggacactgtatagtatattgaagatcactgggtaatacagagaggagggctgggtgtccttctctttgttggttgctgatagataggtgttttctggctcttgctattctgcttggtgaagaccttgtgcatctttctaccacagaaaagctcgtatccagaagtctggtctgaatattcaacctctcttttttctttgctcaaaataatgtaatgaactcagcttatccttttgctccaactttgttttctctcttcactgtcttgtctccctctttcctactgaagggtaaaggacttgagtatatcttaataactacagctatatatttaacattaaagaatttctctgtcaggaactgtgaggaatcatttattgtaacaggacttgggtaggattctaaaatgaaaagacagggtctcactttgtagccctggctggcttgaaactcactatgtagaacagactcttgagctaccagatatatgaatgctgggattaaagacatgtaccaccatgcccagctttggtaagattcttacacttatttgttgccataaatttcagaaaacacttgctggtttcatggtagtagcgttggaggccaggattgcagtgatgaatgcttttagagtttagaatttagtatagggaagcagatgtgtaaatacagaagtgcagcagcagataatgcagctggagttcgggaaggaatttcagaatctcaagaatctgcatgagaggaaacaaaggtttttccttgaagagtttcatcaggactatcagtcacattaagggatttgtacttggaaaattcctttgtcctcagcagctttcgtcaccacatctgagatcggctgcagtcctgttttatagatgcgcaggctctcttaaccccagtcagtactaatactgtgatattggagccatctagtaaatgggagcaacagtaatttttactaaaaacagttgtttttatttagaaaattcccccaatgcttaactttcttctttttttaattaatttattttctcatttactttatgtatatggatgttttgtctgcatgtatgtctgcacagtacatatatgcatggtgctccgagaatctggaaggtgtcagatctcttcagaccgactggagttacagacagttgtgagctgccatgtggttgctggggattgaacccaggtgctctggaagagcagacagtgctcttaacctctgagccatctctccagccccccaatgcttgactttctaatattttactaaattctcccagtgacatgtatgaggaagatcctataatatttccatttttcagataagaaaactggactgacaagatggcttagcagttaagtcacttgtcaagcttgatctgagttctgtcctcaacgcatggtagaaggagagaaccaacttctgcaagttgtcctttgacttatggtgtacatatgtgcttctttcccactcttaataaattaatatgtaataaaaataagaaagttaaggcacagagagattaaatcacttacttagcatcctaacacttgatacctgaggaagctcatcttgtacccaggtcattgccttaaaacggccccaaggtgtgagcatggtgtagcaagctacacctgcagtttgaactgcttagaaggctcaggttgtaggatcatttccactcacaagttcaaactagataacacaggcctgcctcaaaaaggaaaaatagatgcctctacctccacaaaggacattgagactgttagtataattctttctttcaagagttataaagtcagggctggagagatggcttcatggaaaaaaaatattgtaaagctgagaagttaaatatttaacaaagttaaagtggtgtttaccactctagtgggcagcatgaacctggaagagcagggactaaaaatgaagtggcctaaagtctcatgcagtagccaactttgtttggaacatcaggcagtttatactctgagagttaagaagagtcacccaaggaaggtatataattactaggataaaccacgggttgcaaaaatattttcccttagagatatataaacaaataacaatagatatctgtaatgaataatctaaagtcaagtcactcctatatgctatactgggaggggcatgaaagcacattccaagaacaagtccatgtttttgaagaaacggaggtcacaagattcatgactttttttctttttctttgaaattttcttacaagtattcagaatcccccccacacacacacccaccattcttgtactgtgttctgacacatgataagcagtaattatttatattacaagaagtgattcctaaaggctgatatggcttgcttgaacttttgcacagatgtctccacattttctctctcctgcatctttgtttcttaaaaggcaggcatagggaaaggagagacgtagaggtgattgtgcatggtttttagctcagttcagttcaggagatagtccttgagcacctactgtgggtctctcctgacaggcagtgaggatgctgagataaaatagatggtgtttgctgttgtattaggatgaagacaggctaggaagaggtgacactgagacatcattttgataatggtctcctcagatggacttcagccagcacattagacctacagtccatgcctcataccacagccagcaaggcattcatattaattgttaaaataatcacccatatccttgtcctccttaaggtactgttattaatgtagaaagcagtaataccttaaggtattatttaagtcttctcaacacttgaattggtaaattctattttgatgttagaatgctggtaaggctgaggagagagagtccttgtgctgagaactgtgctttaggaaaggatttatgtctccctaggcttcctgtctggttatctgatgggcttcttagttatcacatactttatagtatcttgtacccaagcaatttttctccctaatttggcagaatgaacaagaaatgggaagatttctgaggtcagacaatgaactgagtggtttctaagattagaggctatgccaaggcaatgagggcttattgagtattattgtatgaggaacttgcaaatagtcagtctgtgtctgtgagcattagcacccctgctgtgtctggcaatgtgctaagtgagtggaaaatagtagaaaagttctgtgctgtttggtgagagaagacttaacttgagagaaagagaagtcagcatgagaacaggatactctgcccagggattttaattggtgggttagactctgaagagcacttaaggtgtgcctccttacagaacattgtggcttgtcacacaggaataaatactggctctcatgcaacaaagtcttcctgatatactgtcatccagttctctggtgtcattttctgcagcatgaatccttatgtatcccagattatgtacttattattttcaagctacaaggcaagttaagccttaaacatttgactgtttccacttcccctagatgtggactgacttcattttgtccctcttaacaagattagaatttcttgatgattcctttaaggagtgcacataggcattagatactatagtcctggagaactattgggttgtgagctgtctgaggtgggtgctgggaatcaaacctgcattctttgcaaaagagtataaacattcttaacccctgacttatgtcttgccccaacaaatgctttcttgataaatcagtaaataaatctttttgttgttcctttgtctgagaaactataattatttccttgtagcattcaaaactctgtgaagaaaaaaagccggtaaacaaaatcagaagactattcattttcacctgggcagaacaacagatgagaatttgttttcccctaattcacacagttatacataagcacaatataatatatgatcctgtttgccatgaaagtggcagtcattcaagatagcactgtaaattgttacagccatttgggaaagcaattaggctgcatatctcaaactgtaaaaatgttcatacatatgaccagtaattctgcttctggcaatctatcccaagaaaatatatagtatctagaataaactttccctcagatgatattatttatatatttataataataatatgagaagttagaaaaagctgcaaagaataccagtctagactattaaaaaattcatttagttattaaagcagtagttctacagactgatacttattgaaaactatgaacaaataaagatgctattatatatactgtctaattatgttaatttggaaaaaggttatactgggcatagtttgtttatgcatgtagtctagcattcatgagagcaaggcaagaagattgagtttagtgccatcttgggtgacagtgcaagaccatgtctcaaaatagaacaaattaaacaaatgatctaactctgtaatacacaagaagaaaaacactggaaagaaataatagcacattaatatactataagaaaagtgggggtttatatggttttgggggtgcaggttgtatggtaatttaaaataatagtcattaaatgaagcaaattctcactcaaatggccatataggcatttaaaaataataaagtacatttttaaaatcttgatttctatcttaaacaagaaacaatgtggtaatacttttagtggcaatagaggattaattttaataattaataatagaggtggtaatggcggtggcgcatgccttgggaggcagaggcaggcagatctctgactttgagaccagtctagttgacctacagagcatgttctaggacagccaagactacacaaagaaaccctgtcttgagattccccccacccgactcccccaaaaaaagcaaacaaaaaatggaaggcaaattacaaaagaactattacttaggcaggtggtagtgttcacacctttaatcacagcactcaggagccagaggcaggtggatctctgtaagttcgaggcctaaagacaaccatagcagagtcctaaattacatttgagtcatcacccatatatccgcctgaatgtgggaaataaaaaaagccatagccagtgagtgcatttgttgtctttagaatcaagccttttgtgagggatggtggtcagaattttcaaggagaaggattgttgtaatgaggaaaatatagattctacttgaaaggattttgatcagcccgtatacttgagaggcaacacacttggtttgcaatgccaatttgtactatcctgttcttccgactgattatctgcctgtgaagattttccacccttagggggtcttctttcgtgcagctacatagcaaactcaggtaacacagcatgaaatctccctctatcttcacaacacctatattgcacagggacaggacagaaattttatttctcctttacaggggggaaccttgagatttttgttgttttgagacaaggtcacacagtgtagctgggtctggtaatctgcctggcttagtcttgagagggtaggatagggatgggggcacattgggattagaggtctgcactaccccacctgctggggaaccttgtgctttgaagaagtaaaatacctttccaaggtctctcagctagtagagttgggattaactttcagcccgataagggatgggctaaacaccctctctgttattctttattttctctagtatagatccaaaaagggtaatatgtgcacaaccgtggcacagctctatgcagtgattggagtagccacagactatagagattccagcagatgcagtatactgaatgaacagggatgacttaacagtttcagccctcaaggcttacttgtccatatagagattaatctgtgtgtctggttctcacggcataaggaagctttttgggggaccttgccttaagggttctttttctgttctcctcaccttggattctttgtatgttcaatagactgcttttttattccagatacccattcattatttatttattgagcacttgatggacacccagtcctgtgaccttcagaatcatccctgtggagttaaaagacaagtctttactagaatttggtgacccatttgaagagtcttgattgtatccagtgattgtactgttctcttcatcatagtttgactctaggttattgtcaaagtagagctgaccacctgtctcattataacctcaaggaaaaattttttaagttctagcagtaataatcatggtaggaggagctaatatatgcatgctttgtttgcatttgagtgccaggattagaggcctgttctacccaacctaaccttatttgcgtgctttggaatgttttagaagtgtacatgaatttagttgttttatcttccaataaccctattgatatgaatagctgccctgttttaagatgagatatcttcacaaatgatgtattttggaggctagaaagatagctcagtggtttagaacacttgttgctcttggacaggaccagggttgagttcccagtacccccattgtggctcacaactatatgtaactctagttccaggggactcaataccatcttctgacttctgaaggcatcaggaggtacatggtacacatacatacatacatacatacatacatacatacatacacacacacacacacacacacacacacacacacacacacacaccccactaatacatataaaacaaatctaaataaaaaatttaaaaagatagagttagcatatttcatgaaggttacatcacacaactagttcagtaatgggatgaaaggatgtggtttcaaagattatttattctcatgactacagttcatggttccttacaagggaaagatattcaagtgctgacttttgcttgatggcaagctgtatgggttttttgtgttgtttgtttgaaataggatctctccacttagcctggctgtcttggaactcaatatgtagatcagactcacctcaaactcacagaggtctgcttgcctctgcttcctgctttgcttgacttaaaggtatacaccactgtggccaacttattttgttttttaaagtgtatttttttttaaagatttattttatgtgttttgcctgccctttgaggccagaagaagacattgggtctcttggaactggagttaacagttgttagctgccttgtgggtactggaaattgaacccaggtcctctggtagaggaaccaatactcttaactgctgagtcagtgcaactcaggccatgcatttaatgccaactcacagcaagttgtttctttctctgtaatgcgtattgttagttctgcttgtactaaaaataacactaggtattctcttttcggggtaggggcaaggtatagttgtgagtaccaggacagccagggttacataaagggatcctatctttaaaaaggggggtggggtggttaaaatagaaagaagtttgtacactgaaaatttagctgtgcataaataaggtacaaaaacgtcaggcgttggtggcacacgcttttaatcccagcactgggaaggcaggcggatctctgtgagttcgaggccagcagagcaagttctcaaaagcaatacagagaaaccctgtctcaaaaaacaaacaaacaaacaaataaataaataaataaataaataaagtacaaggtatacaagtagctcttgtatgcattctcagctagccacagtcttaggtatgtagtcttttgggggaatgaatttgttatttctgttactcttaacttcctagatgaaaagagaggctgatgtataaacagctacaatacaagactgaacataataagaggggttagagatgtttcagtggttaaaatacttactgtgcaagcacaggcatcttgtgtttggatcactgatgtccaccatgccagatgcagcattccatgtttgttaccttggttcttgggcaggggcctgacataggcagatcctgaaatcattatagcagacctgggtttagtctcaaaaaaactaaggtagccagcaatagagaaagctacctgaagttgacctccaccctccacacataaacacatgcacaagcactcatgcacacacatgtacactcacacaaatagtaacaaatgtaggacatggcttttcttttcattttgtttgtttgtttgttttgttttgtttttttgagacagggtttctctgtggctttagaggctgtcctggaactagctcttgtagaccaggctggtctcgaactcaaagagatctgcctgcctctgcctcccgagtgctgggattacaggtgtgcgccaccactgcctggcctctcttctttcttttttcttttttggttgaatttctttattttttgtctttttttattttttattttaattagattattattttacatgtcaaccccaggtccctctccctcccctcctcccctgctcccccaattaataccctacctatcctataacctttccactccccagggagggtgaggccttatgtagggggtcttcagagtctatcatatcctttgggatagggcctaggcccacccccttatgtctaggctcagggggtattcctccatgtgggatgggctcccaaagtccattcctatgctagggataagtactgatccactacaaggggccataggtttctgaggtcttctcactggcactcacattcaggggatctggatcagtcccatgctggtttcccaactggggaggtcagctgtttctgtgggtttcaccagcctggtatggaccccttgctcatcagtcctccttctctgcaactggatttcagttcagttcaaggtttagctgtgggtgtctgcttctacttccaccagctgctggatgaaggctataggatggcatataaattagtcatcagtcttattatcaggggagggcatttaaagtagcctctcctctgttgcttagcttgtaagttggtatcatctttgtagctctccgacatttccctagtgccagatttctctttaaatctataatgtgtccctctattatagtatctcttaccttgctttcttctgtttttcccccaactcaacctccctgccccgtcatgtcctcctcacccctcctcttctccccttctcattctcctagatccctctcccccctacccccatgctcccaatttgctcagatcttgtctctttgcccttctccaggggaccatgtgtgtctctcagggtctggatatggcttttcaatcctgcttggtttcctttttcttttggtgtatagaaagacaaaccaggaatatcattcttctggaatatgtcctcttcttaggcctctggcaccagaagtttgttctagttcttgttaaacctaaatcatcttcccttgtacatgatctacagagtagataaccaagataaattacccctagaagaacatatccttggcctgcctattctctttgctcttaaaaggatggtggtggcaatttttagaaagtagtcttgacatcaaagtctaaaaaattcaagctaaatgacttaatgacttgaaagaaatgaaattaattgttttgttttctagtgtttgatagggcagggcctggaacctatctgttattgctagttcactctaagtatgaaaaattgagagtaaatatttagaaaccttggttgcttggcattttcttctatcaggacttaggtgtgataaattagaattttgcactcgggaggcagaggcaggcggatctctgtgagattgaggacagcctccaaagagaaaccctgtctccaaaaaccagaaaaaaatataatagattagaattttaaaaaacaaaaaactaatccttcatgaatagttttgagaaatactggcttacttggttattattagtatgataaaatagaaaagaacttcagtcttctggtctattaaacaatcaatacctacctcaaagaattgctttattgatgatttgatggtagatatttgggttacttaatatacttgttcacatcacttaatcctcaccaccacactaaagcacattttttctgagactgggtacgttatagggctgtaagtgaatttggatctgcatggagctatgctgttttctgcatagagtgtgcaaaagaactcttccttgtcccgtagtgtaggggatgctgtagccacgcctgcttaggggctggcttttctaccatggtagctgggtacactaatggcgtacgagaagcaaccttagaagaatagtcatgatagctgggtggagtaggtgcctcagattggagtgattctgcctctgaggcatcccaatgatctttaagcctagtaatggcatccttatgaaaagtttcaatctccttaatcataaaagattccaagcatgttagtgaatctgtaaattgctctaactgctcctctacacatttttctaggtctttaatacggtagtccttaggcaacatctggatagtatggaaactgccttctaggtatttgagtctagattcgaggtcatgatttgctgattttgagtcctcagcaatcgaccatatggacctatctaatctgtcagtcctgtactgtagtaaattatcttctaaacattcaaatatagactcaaatttgtgatctgctaccttagatgcttcaataattgatggaatggcattgtccagttcttcaaccctatcctgggtattttgcacctttgcatctagtttttgggtaacagtgtctatctgagtttctagctggctacagatattctttagttcacatggtcctctgacaccctagcctctaacgcctcagacatggaggatctctctgtgtttatcttatcattaatatgctgcatctcatcttgggtaacagacaactctgtctttagcgtattggacacagagccaagcttatcatccaatttctgttccacttgctgcacaattgtgatctgacctaatctgttctccaaaacctcattgcgtaaagctgttatttcttgcaagcaggtggtgaggttatctttgtccctgttcctgagccctctggctagtaatattacttgtatcagcaagctaactgccattacggcataagtctggtaattggcagattagcatcctcctcaaacactgaattcacgtaataagcaaaaatattatcaattttagcaaatgataaatattctgccataattttacctgatttctactccagatgcagtaactatctttgaccagcaggtggtgcaggcattcagctactcagcaccgcttttggcagtggtcggtcaggcaagatggtcacaaaggtggaaagaggtcacaaaagtggctatgcttatcttagagagtatatggcgttggagccgcaacctctgaaagagatgtggctttaaagcagcagcaaggggaagagagggtggggggctgctgaaagccaaggcctacttccgaggcctctcggctaagggcaggaagcctccgggcatgggtaggctgcagtccgagctgttctggtggctgcagctagaaacttcgacagtaaccatggggaggtctgtggaaatttcctagctgggctgtcggttctcagcagcttatcagcagccagaaagcgcttgtgtggtgcggcgggtaggctgggagcacctgtggaaggagggatctttccctgcctaggccgcagtccaggtgggacctgcaggctgtcccaaatggaggctagatttacaatatcccacttctgacaccagataatgtgggaaattaccaatatggagccaggtagaaatacaagggattttaatagggaaaaggccttacttacagagtgacctagccagctggtgggcagcaatctgtacagcaagctaaaagtgaaaccgaaagcaggctaccacgaaagtgtccctcactctacatcaccctcaccatgccctcacaggcgtggtcaggcacacctttagctaggccctaagcaggtgtggctacagcatcccctataattgcttaggggctggctacagcatcccctacacagtagagttccaattctgtcactaacctaacttagtttttgaccttaagcaagtcactttgtctggttcttaattttctcatttacttgccatgattgagtgaccatattttatcatcttacattccttagtatctagcatgatcagggcttagcgtgttaatgggtattgaatactgtggccactgattgtaatagaggttttcagtttgttttatctgaacatcctaggtattttatcttatgcctttcctctagaggatcatgtttcatattatttacgtgtgtgtgtgtgtgtgtgtgtgtgtgtgtgtgtgtgtgagagagagagagagagagagagagagagagagagagaggagagttctacctgcatgtatcgtgcaggccagaggagggcaccagatttcattatggatggttgtgagccactgtggttgctgggaattgaactctcaggacttctggaaaagtagccagtgctcttaaccactgagccacccatctctccagcccccatgaatgaatgaatacatacatacatacatacatacatacatacatacatacatacatacatacatacatacgaataatgttacttcctcatgtctattttaggcaatctctaacctgaatactttgagataaccaatatggcactatgggatgtgtctaaagtaaacaaccagggttattataaggtaaaggtagaaggggccggctcaaaagtcagaaaaagtactcttgtctattgttactctatggggcttgggcctggggcagccctgccaggcctgagtaatggctgcagcctggagcaaggttttctgtgcactgtattggggtctccagtaattggaacatggcactttccaacttataatggatagcagaacaagaggggcatttgtcactgcctgacttccctacaggaaaaaagctcataagtcacagctgacaaaccctttgatgatttttaaacttcatttacagcaaagaatagctataatcaagcaacagcaagcagtgactaatcttgctacattatcactgtgaggagccagcctcgtgaggtatgagaagtgggaggggtctgttttgcagtttcatagtaattgtggattggctcttgggcttgtgagtgtgctctaggaaagaccacatgaatttgcctgaaggatcagaagctgaccaaccgtagactcagcattgaagccattgaactaactcttgtctggtctcactcagatttgtgccacctctggcttcagtgggacaccatcatctgcttcagtaagaggcttaaaagataaaatagttgaggtagatagtaaggactctttatgattgcccatgtatacagacctggaagggtcttttgttgtctaaaatctaatgttttgtgttccagaggatgacctatggcagccatattttgggttttgaacaaatgagctaagtatatagcacccaaaataaaagaataaatatcggccgggcaggagtggtgcaccaacctggtctacaaagagagttctaggacaggctccaaagctgtagagataccctgtcttcaaaaaccaaacaaacaaaccaaaaaaaaaaaaaaaaaaaaaaaaaaaaaaaaaatatcaaatgatagatagatacacagatagatgatagataggcaagcaaagcatcatatcaagttcttaaaacatccagcagaaattcactgggggaagcctctttaagtcagtcaaatcagctagagttcccaatagtgagtccctagtagtgtcccccttgagtgagggtcccaagtaaaagaacaaatagcatagtacccaatttgatattttctccatggctggactttgagcttttctttaccactgtaggtagttttatattgtgggaaaaatgatagcatttttaccttttagctattctcaaatcaaatagctttactttggggttattttgttgtactttttctccttgtcagagatttgacaagacaaatttgaaagacaccacccagttaagaggaccaatttatctttagataaggggccttggaggatacttttgagacaaacatgcttgggtctgaaaacagcaagggaaccctgattcgaggactagtttctcagtgagttcaagtagcacaaggcagtttaccagtataatgtatattgtatagattatatggacattactggtaaaggcaggatcattcttatggatggagaaatcactgagagtgatctcatggagaaggaagaacataaatgatcaaagttgcattagtcttctcactctaatcagactaattactgtggctctctgagactcggttgcttgttagttttttaaatttcctcctttgtggtacagaggagagaacccaggacttcatgcatgctaagcaagtactctactactgagctacatccccagccagagacttggctttttaatctgtagaatgatgtggatactaatttcattaggttgatcaggatcctaaggaatcctgtgtataaagcttccatgcctctccgttaaaggtgctgtgtattgtgttctccttcaggacaagaataagtgtgcatctatcaaaggaatagaaggccataactgaggtgttgtcccatttcaaacttttgccagcctactctgtaggtccatttacagaagcaggtgaggcagacaagatacgagcttccatgtggacactgagaattggatttgggtccaccagaagagcagtcagtactctttaactgctgagccatctcaggcttggtggcaagtgccattatcagctgagccatctcactggccccctgcaaactatctctggccatagcagaatagctttaattctgcttgccagttgaggattctgaagcctagcaagtgctagggctgagctcataagttgacaggactagatttggaactcagtcctacctgattctaaagtttatgctgtttttgctatttcatcgtgtttgggggtggggtgggaaactaacaacagtaacaaactggattcccaaaaatgcctttttttttttttttcttttcttttcttttttttattttgagacaggatcttaactatgtagccctggctggcctgaaactatttagactaccctggcctggacttgcagaaatacacctgcttttgccttccaagttctgggattaaaggcctgtgccactatgtctgtcgaaagagagcttcttgacaaccaagagagcagtctctacttggtttctcagcaaggccagtattggaaacactcaaaagtggttgttgaatgtgagggatagtaattgggcagtaagagaaataggtataatcctatatcttttcattaatttgttgcagatacaacagagcactttcacattggttagctcatttgatcactgaaaagatagagggagatgctttctgttttcagaataagggtgttgttgtttgtagaaatcacatgacttgtttcaggtggtatgaacagccaagccaaagtggagccttatgcgtctatagccagttcagcttgtactttcatgtctctagaaagccttctgtggttggctagttgagagctggggtttctcatgggagtggaaatgtcagtgctacttgggaaattagttctgtctggccagtgatgatcatttgggcagtgttaatgagtaggggcctgaagagtttaatgagattaatagatgttttgtcacccatggctgcctggtaactaggttctctggactgaggagttcctaaacactgatccatctaattgcttggcttcctccagggatagtctcctatcactgacagctctttactacttgctgccctagggttatctgagggtgtaaaggcaggaaaaaaaccaaaagtaacccaacgtgattggctaaaactaagcagcattggggcaacaagaccaagagaagcagctcctctttggaagtaaacattccatgaggaacaggtccagtcctaggcaggtttaaacacgacttaattcaatctgagaggcaggattggaagcctaatgagggaggcatgacaaagttagagtcaggtttacagtggataagtctagactgtgtaatgtcaggtcccctcaatagctgtttgaccttacataaatcatataacttcaaaaaatcttcagcctttaaaagggatagggggatgaccagcaatgatattattttagccctttttgattctatgacaaaattgctgttttattagcaataaatttatttattcaagttctagagttcaaaatgaaggcatctggttaagtgtgcccatggttccaggacaggtcttttttgttgtgttcctacattgtagaaagaaaaagatagttctgaagaggctctttatttttatttatttttttattatgtatacagtcttctgcctgtatgccagcagggggcaccagatttcattcaaggtggttgtgagctaccatgtggttgccgggaattgaactcaggacctttggaagaacagtcagtgctcttaacccctgagccatctctccagccctcaagaggctctttatattataaaggtactaacacccatttatgcagagttggttcttatgacctaatcaccttctaaagactctgttgccttttgcccttagataccctgggggatatctgagtggtttggaaagaatgttgctatcaaagataaagacaaccatttctggagaagctaaccagtttccccaaagtatctactacctccttggttcacctgctcttggttaccaggcagctagggatggacagaaggcctgttgatctctaagctcaggctaatacgtgttcatgttggaaattaggtttcaacgtagaatttgacggaagaatgcagagcctgacagagatccatggcattcataaaagtcctgtgcaaattgaagaattgtagaaaggggaaggacaaggagggtgtgtgtgtttgacacagatgagtatcttgccctagaaactattaccttgggaatttttgcacacacaatctggcccctgtggatgcctgtatttgtttgttttgttttgttttgagacagacttgaattccatttgtggctttgctttattaacttattactttgtctcatcttcctatttaaagtaaatccttatgtgaagattaatgggaagagatgcaggaagcactggtactcagaatcagaggctctttttactgtaagaggtttttgggaagattctcaattacccaaaatttaggagttgggaggtaccttttaagacttttacatttgcaaagctctttggttttttttctttctttctagtgttggcttttgtgttctagatcataatttctatatgaaatgtttgaatttgggaaaatggtttgtgttttgccaaatttcttactaacttggagaagttggcccatcccttccagctgtaattacatttcaaagcttttgtccctggtggggtttaattagtttaaggctccagctttttagcagttgtttatctagcaagtgcaagtgaagacattggcctaggaggcagcctcctgtagtttttctccagcatagcagtgtttttgagatgctgtctttgttttctgctccatgttttcctggatgcccatctcacttaaaggaaaaaatataatacaaaaatcctgattttgtagggtgtgatagcctaggcctgtcattttacttgggaagtggaagtagggagatgaattaaaggccagcttgagctacatgaaactcttgtgtttaaagagagaggttgggagagtgtggggggatggagagggagagaggatactgaagggcaaaggcaaaaaacaacaacagaaaacctagattagagctagaggacacctcaaaccctgaggtttatggaccatggtatcctggccaggttctgctcctctttttttttgggggggggtctcagtaagaacatatcaccaaagaccctgctaatctgacgttacagatatctctaacaacacatgtggttgctgtatgacctctgccctccccaggcctaccacccacctctcctcagcttattgttaagcataaaaacctctggagttgttggtaccttgctcttagttacacaatttataaagcaaagtttggctggtagtggggactagcttatcaagttagatagtttttgctgaaaaggatattgatattttaggacccccactcttgaaaaattcagaaagaggctagatgtggtagcacatgctgataatcccagcagttgaaaagcaggaggatcaggagcttaagatcatcatccttcaggccagtcttagttatgtgctactttgcctttttctaaatgggggaaacaaaatggggtgtttattaagttgggggtgttggtttgtgagggtgggcatttggatcagactagaaaaccaggcctgaaagctagtcagtatggcatacacctctgtagcaccatttgagggttccacaactccctagacgtgcgtctctcttcctgggcttagggagtctacagagtaacatacagcctatatgctaaagcatcatgcaagacttaaaagatcaactgggaggatatagattgggggtttgggatttggacaccagagcatgttccatttagcaggcacgtgcatatacttggtcttctctatagatcagaacagggtgacaaggttgactcttcttggtatcctaagaatgtgctccagtctgatcatgactctaatctagagtggtcccactactggtggtattaatagaagagacaaatacatagaattatactaatagtggatcttgtaaaggcctccacagtttgcaaagttcttttatatttattgtcccaaagctcaagtgaggagagaaatgattggcagagccaaacctgaaagactgttctccagcaagccagtgagtgctgatccctacacagtactacacaaaggagctcagtgaatgcttcctactcagttgtgttagaggctcctaacagtctgagggaatccactactgccctgtctttgtcatataaatggcagagccagcagcctggttggttccctcctgctgaacaaaatggcatctttctgtacagttttgagcaggatcagtcatctagtgtcatgtaggcaccttaaaaagtttctttctattagtgaatgaacaaggaattaaccattgaatgaatccagataggaggatttttgtaactgaaaaatggggagcattaaatatttcctatgcttatggagagtatattggctgtgttcctgggtatctccttgtgtccttcactgctttataaatgttggtgtaagagtaaacctactaacaagaacctgtcttgtccaagttagttctaaagctcatatcagcctcttcattagtagcagcaagttaaactctgagcccttgctttatggtagtacaaaaagataacacatttctccaacttgcattcttacttatttctctgaaatgaaacccccaacccccagccctgtattaggtagaataaacatgcaggttgatgaaggtttttataccttctgcttggaggttatttaataccttctgaaactgccctaggagataagattcaagttgcactccgaacacgggcctagtaagtacaaatgccacaaccagactgcaaaccttgcctgctggaattaaacatcctctttcctttctcttggggcttatgccaaggtacaactgttctgcagagagactctgtaggataaaatgcctttttttttttttttttttttttttttttttttaaagccagagccagagtctacctggctgacctgaagaatttactatgtagaccaggttggtcttgaactcacctgcctctacatcctgagtgctgggattaaaggcatgctccattgtggccaacagaacatatattttaaaaagccaagtataggggcatgcacttgtaataccagtgctagagaaatcatgggtaggcttgctggctatccatgcctgcttactggacaaaagaacaagcgggtggacttggtacttctactgatctgcgtatagacacacataacaagagtagttgcaaacttgtttataagccgaatagattttgagtctgtataaagttaataactaataaattaaattactaacgaccattctcaggtaaattcattatcttaactatttaaattggctttaactctaggaagcagtgatgaagctgacagaaatgggctttaaaagtgtttaaatgcctcttattagcaagttaacaatcttaacaaaaaacaattagcagagtctcagtttctggtaaaataatctgtattcatccacgagttcttgggatcattcaatattatatgctactcttagcctacagtgagtacctggtaagtctatgtaagcacacgtttttgcagagtggctggcacagtaaagactttactggctgggttagtaaagatgaagtatatctagatcagacaaagcaatttttataataggggactgttcttgaaattaccatgtgttctccttgttatggttctgcgttgaaggaacagaaagaaaagctgtagaaaattatttagttttaaaatggggtaacattgtgattttttttcttttttttttcttttttctttttctttttttttttttttttttttgagacagggtttctctgtgactttggaggctgttctggacctcgctctaggctggcctcaaactcacagagatccgcctgcctctgcctcccgaatgctagattaaaggcatgcgccaccaatgcccggctcatttgtgatatatttttaaagatataaggttaaaaaaaaatgcaatcgaggctggagagatagctcagcagttaaagagccctgggtgttcttccaggggacctggattctatccccagcaccctcatggtgactcacaactctctgtgacttctagtttcccactgaaaaaacaccaatacacatgaaataaaaataaatattttttaaaactggagttaagagactggttaatcccagccttgctgttgactagcattgtgactttccagtgtagggttttcctgtgtacagtatcgtgagtaccaaatgagggaatgttgtaaagcacctagtgtaagattagcagccaggaagtggcaactcttgataatgtcaccagaaaacaggatgccagaacagggagaatgggtaccatagggttgagaatgtgtacaaaggcaaggagcaatccaggttagtcagggtatctattggccatgaacattccccgagcctggcctgggaacccagcttcacattggcgttatcttttcaggtggacaccatgtccttgaagattcagaccagcaatgtaaccaataagaatgaccccaagtccatcaattctcgggtcttcattggaaacctaaacacagctgtggtaaaaaagtcagatgtggaaaccatcttttccaagtatggccgtgtggccggatgttctgtgcacaaaggctatgcctttgtccaatatgccaacgaacgccatgcccgggcagctgtactaggagagaatggacgggtgctggctggacagactctgggtaagttaacctcttctgagtagctactgcctggaattttatgatttcaacagataaaaattatatttgtaattcttaaatgagtgccaagaggagaacacatggttatagagggcccctttctcctgtccttgctttcccaattcctctattaaaaaaaaaaaattatttgtttctgggcttgatggcatgtgctattaatcctagcacttgggaggcaagtggatctctgtgagttcagggccagcctggtctacagagcgagttccaggacacctagggctacacaagggggctcctgtctcaaaagaaaaaaaagtgtttgcatacatatatatgtgtatatgtcaaccatggttcctgtgtagaggtcagagggctagagttggttctctttccacctttatgtgggttcttaagaattaaactcgtgtcatcaagcttatgaggcaaacacctttcccccccgatcttcatagcctcctccccccacccccttaaattaaaaaaattcttaaatacaatatattttgaatatttttttcttccctaactcctcccagatcttacctacccatctaattttgttttcccccctccttctcaaaaaaaagagaaatgaataaaaacaaggaaaattaaataagaaagaaaaaaaaaagataaaagtgccaaacaaaagccccccccccaaaaaaaaaaaaaaaacatgggtttggtttttgctggccaactgctcctggtatgtggttgatagacccactggcaccccattggagaaaactgattgtccttttgcctacagatgtcggttgcaaatagcttcttgtttaggggtaggaccctttgtccacttaactccttttagtgctgcaacccagttagtcttgaacctgtgttggtcctgtgtgcgctgccacagcctctgagttcatatatgcattagtcttgtgtctggaagacaccatttctttgtagtgttcatcaccacctctggctcttacagttttttcctcctcctcttctgcatagatccctgtgccttgaggggagtggtttgatgaagacatttagaactgattgctacaaagtatcacaatgttcagttctgggtctctgttaattcctgtctattgcaaggatcagcttctcggatgtgggttgagcagtgcactcactgatctacccccatagcctcttaataacaagctttatggttccagctaaaatccaggttctccgtagaaagggaacaaaatgaactaatatagcctgttaccccaatctacagaagatatgagttagaaccctttctaaaagctatgaggagctgtgaatacaaggactaaagggaagatgcgtgctcttggcattattgattacatacatatgaaatgactgttggtgtctaccttacagtgtgtgtgtatgtgtgtgtgcatgtgcttgattgctcatatacgtctttgtatgtgttttagaaggtatatctatatgtatgtattagtgaatataagatatgcagatgtgattgcatttgtgagtgtgggagcagatgtgcttgcttttttacttaatagtccttgatcttataggctatgtatatatgagggtatagatgtgttcatatatacccgatttatatgaatttacttgaaaatatgtatttatatggtatgtgaagacttgtgtatatatctgaatgtatatgaatatacaactaggcagatccatatgatgtcctggtattcttgtaatgtttgaaaattaaatgtttaaagacctttggctacctcagtcccatgtgtacactgtgtaaatacacagaggcatgatggtgatgtgtgttggcatactgctgtcatgttagcattccaactctgcgtcttccctccacacagacatcaacatggctggagagcccaagcccaatagacccaaggggctaaagagagcagcaactgctatatacaggtgaggctctgtgttttttttttttgttttttgttttttgtttttgtttgttttgtttttgttttgttttgttttgttttgtttttttggtctgcattggttgggtccctcttttcacagagggagtaaatgctgatagtgacagtgtaccaagcttagaatttaggaagattttggagatgaggacctgtggagaagtgggctgagtagccatctccctttgttttcccagtggctacagctttgactatgattactatcaagactacttctattcgaggtgagcagggaaggggcatgtcaaggcattaaatagccaaactggaagggtcttaagagattgctggtgtggctcataaagtcctccaattgggaactgaaacacagagatgtgagtgagtctttgcttcagggttgcttcacaaatcagggacagtgctaggactaggatcccattttgtaagtgctcaggccagagctcttactgtcacaccaaactctcacattctgactaccttgcttcttcttagttctatagcgtaggggagtgtatagctaaagggtgaacacacctgggcacagtgctttcacaggtagtgcccataaactctgttcagtctttgtctctgtaaggtgctcactcagccaaaaaagtcagacctacagatagtttggtctgactcttatgactaagaagtcctagttatttggaagcctgcgttagtccatgatgagttgtgatctgccttctatctccaatcctacctacacttcaaccttgaagtcttctagaggccccagccacatttgtttgttgagaagttttaaaaactcattatcctcctatatctgcctgttgagtgcagggattacaagactaaacacaatgccagctcctggtcatgtgcttgactagaagttgtggtgacgattaaatcaaaaggtctccttccttgtccagacagcccagggaaaagaattcttctgaaccattttctctgctgtaagtgttaagtgtcataatctggaaattcaggagactggatgctaatctcggccgtgacactgaataggtgtatctatccttgggcaaattctcctactcctagtcagtgacataggcttataccaaatgatctctcgggacttctgaagttcttgagattccagggtcagagccatcatctccccttgtgggtcaaactgaaggatcggggattgcattcattcccagagactgatcactagttgccaccacctgcaggactctttgaacaggagtaccaagaagcaggaccttgagtatcctagtggtggcaggtaccgtgactcatcaaaaaagtagttgtagagtatatccctgatcaaggctgtgcttcccttcagaaccatggtcattgcacaggtggtgggagagttccctgctcagccttgggtctaatttagctgcccatcctcgaaataatgttgagcacttggcctatatatctctggagaaaaagaaaggtgttgaaatggtccaaaagaaaaaaggagcttagaagtctgaggccatgggttcctcatgagtgcttcagtgccctagtacccagcttttgtttgtcaaaccttcttaagtgtttttagtgaggttctcatgctctacccttcctgcatactcaggtagtcagtgaacttggacagccctcttcattaagtagatgggaaaactaaggttcaagggttggccacccattttcaaacctctctgtttccaggtggagactttcactgttttgatttttacagtatgatcagatgaaggtggggtgattatctgagtagaaggcggtgccttcaggaaaggctccttttaagactgggctgtttgtccttatactgtttctcctagcatggctggggataaatctgtaggtgcaaacagtaaggttttctttcattagcctttaggatctggaaaacccctttcatcataccagggcttgttggaatcattcacttcttccctggccctttccggtcacacaggtgaagttagtattgtagtgcctcctggtggtcacaggccatgctgcagcctctggtctgtttgcctttgcaggctgtttgattatagaggccgcctttctccagtgcctgtgcccagggcagtcccagtgaagagaccccgtgtcacagtccctttggttcgccgtgtcaaaactacaatacctgtcaagctctttgcccgttctacagccatcactactggctcagccaagatcaagtgtgagtgacttttgttgttgttggtttttgttttttgagacagggttccactgtatatctttagctggcctggaatgcactatgtaaatcagactgatgtaaaattcacaaaaattcttctacctctgcctcctgggtgctagaattaaagatgtgtatgccactacatcctgatgacgtctttcaatctttctagatttttgaacccctttggggttggatatcagatatttacaattcataacaatagcaaaattgcagttaaaaaagcagcaacaaaataaacttatcgttgggggtcaccacaccacgagggtcgcagcatttggaaggttgaaaaaccactgttccagatggtttgttttttattatcactaaaatgatagaatcacattttttaacaactgatttttaaaatgttaatctttgtttttattttaagtatgtggtgtttgcctgcatatgtctctgcaccgggtatatgcagtgccagtggaggttagaagttacagttttgagctgtcaatgtctgtgcttgggatcaaactcgggtcttctgcaagggtaaccagtgctcttagcctctaagccatctctgtagcctccagaatcatactttattaacactgagaaaggagtaaatctgtagttgaagttactcttaataatcaagtgtttggatgcatttctaaagaaagtccagtgctgtggtatgatagtgttttttctctagtaaggataagttcagatttattctggtctttgtatactgcagtcagacacccaggaaatctaattgcagaagaccttttttgtacctttaaaaacataccacatcctgtaacacagctaaaaagacactccattacttaggtgttcccagaacacaccacagacctacattgtttttctttttgagacaggctctcagaatttaaaccagattaactttgaactcacagtatccctgcattagccttccaagtgctgggattgtaaatgtatgacccacatggcccagtcctatattcctgtgtatttgcagtccctataggatgggagctctagggcaaatgacaaggatcggattatgaactggtcacccctggggcccgttggttctctcaagaagagacccttttccttggcaggaaaagaaccaaaaaggaatggcttccctagttgatagaatgaagctggggttttgtttgcattgtacccctaagtgataaccctgtctcccctctactcccagtgaagagcagcgaactacagaccatcaaaacagagctgacacagatcaagtccaacatcgatgccctgttgggtcgattggaacagatcgctgaggaacaaaaggccaacccaggtcagctttgagggcagcccttgggaagatagtgtgccccaagggctagggatttgaagctccaggccctgagacttgatatgtagtgaaagcccaactttcacgaaggtgtgctgcatagctgctccagctgatttctagtcctttctacttcttttaccctcaagatggcaagaagaagggtgacagcagcagtggtggaggaggcggcggcagtggtggtggcggcggcagtggcaatgctggtggcagcagcggcagcggtggcagcagtggtggtggcagtggcagctgcagcagcagccggcctctggccccccaggaagacacggcttctgaggcaggcacaccccaaggagaagtccaaactcgagatgatggcgatgaggaaggactgttaacacatagtgaggaggaactggtaagggcctggctagctatgtgactcggaagggctagagctgtccccctctgagctccttcctttctgctttccagagtgccagtcctatgaggagtagggaagaatgagcagcgtatagttcattgtttgagctgctggtccgaagtcccactcaatactagacagacctcagcaaagcccagggcccagtgcaccttctactctgggtgtattaaagaggaggagaattacgcctaagagttgcacacacaacctctcaggaatggttggtgttgatgatgaaagccatgagaagatgggaattttaatttcacatgagaattttctaaaagccattgcctttcaagcatctagcaggctgtctcttaaaggagtaaactcctgtatatatgggaagtattcagggtgaggttaggagccatgagagggcctaaattgagtgaaaaggtctgatttctttcaacactcaagatgcctgctacagtgtttgctgcttgtttagtgaacacttgagttgaatatcacactttaaccttaacaatagattagattagaatggccacatttaccttgaagaagctgaagctcaaagttaccaggtaccttgctcagacttggtctgtgataggtgtaagtcctcctatgccacacttgtttttcttttctttcttttttaaagcctagcctggtacttcatcttattctcttaggcatagtactctcagtaaaagctctaaagactctgagttgggcagaccactgatctatatggctttaagctttgctgtagtccatggtctttccatgcatagaatgtgtccctgttacactagcaaatcccaggactggtcccttaactttgggatcttcagataaccctctcaggattctaagccagttttattggttggttccctttagttggacctcctttccagcagtcctctgagccacaggacattcctgaacagatagcgcagggtagaacttgtgacctacggtgaatgatttgtgcttgtcttcctcctctcaggaccacagccaggacacagatgcagaagatggggccttgcagtaagcaggtatggggtgcctagggagcacaggaaatcaatgaagtgatttcctgcaatttcttcctgatgtgggtctagggagccatactgtgccgaggctgaaggtccttacatgcagccttactgcagtgtagtcacacaaatcaggaacactcagagagtgttctcttgggagcaggatgacaaggaaggaaaagtgtgaactggagtggtggaagaaatgctgtgcagcttagtctgcctcttagtgagggagaagcattccatagggggagagaacagacagccttattggagcacagcattgtgacagtctttaaggacaagagctgtctgttctgtagcccagccctgcaaggtaggggaaaggtgccatttgttttaagaggggatgactagaagtgtctcattccccccttccctcgttaggtgttcaacttgatcctgttaaggggaggagacgccctgcaagcttttatggcaggagctgttaatctgatctcttctaccctgcaagattaggattgtgtgtatatcctagaagtgggaatgcagatgttgaagggtagaatgaaacatcagcatgtctcatgagattccaagatagtaattgacgcttaaatttgaattcagtaacatgcagccccaaagcctccactctggccactgtctgttatcctgttattccctaccctagaggagtttacaggtgacagagaggtgctttggtagataacacatttgtaatataggatctctattagttagagcttccagattagttcagaaatttcctcatgtaagtcttccctcttgaaacttaatttatttttacccagaagactatttatatattgtgcagctagttcatgttaggttttaaaggctcaggtggggagatcgctccgtccaggggttgagcctttcccacaattaattacatgatcagaaaattgggaaaggtgcagacatagcaccgcaccccttttccttacccctatgatcagagtttgtctcagccttagtttcttctttgccttgacaggaaaaatggccaccagcagaagaagggcatcactgtctcaggcctcaagtcaggcacccatctctggatgccagtttgtagtgggtaccaggggaaagctgccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccccagggcatcccagccagtgagtgctacgtcctttgcaagtggagttactggcctacccttaccccatgcactcttcctgtctgcactgcctgggccaaggggcagaacacattctgcccttcttccccagggaattcccaggcttggatttttctataggtttgaggggggtgggggtgggggtggggttggtgggtgaggggaaaatgacaataaagagattggatccaaatatggtcagatggaatggtttgcttatttggctggttttatttacattgttattgtgcatgtatggtgtggggtgggatacatttgcatgtcacaccatttgtggaggtcaaagacaacttcatggagacaggctttcgaaggaaacactttacccactgagccttctcactgtctctacttctatgataaaacactatgaccaaaagcaagttgggggaagaaagggttaattttatcttctacttccaggtaatagtccatcatttggggaagtcagggcaggaacctggaggcaggaactgatacacaggccatggaggattgctgcttacaggtttgctcctcatggtttgctcagcctgctttcttacagtgcccacattggacttgaccttcccacatcaacctgcaaatcaagaaaaggcagcatagcccagtctgatggggaaattttctcataattaagcagccagcacacaggcctgtggtttttctcacagtggtattttagccttctgcctatcaaaaagctggtatgctcaacccttctgttctcccatctccaggaaacactgtctccagtgtccaatactgatccatttgcaccagcactcctctgctaaaatgattaaagttaggtgtgatggcacatgcctatcatccaagcacttagggaagtggaagcagaaataccagttcatgactggtcaggactccatgagaccttattttatctcaaacaacaaaaaacaaaagcccacaaatgtatctgccatttttggagtacctatgcaaacactagaatctaaatcgctttaagcaagaagtagctttattcctttcctaatagtatgtttgtaggaattttaaattttaagcttttcctttttttggtaaacttaagccatctgttctaccctattactgccgtttttgggttgttaaaatgttaaaatgacactcaagtcgctgctttgacctggctcctttttccgtttttggaaatgcagccttgattcagctgctgttctggtcatttcagggatgtttcagtactagttgattgttcttaaagaactaactgttaccttcttggaaaggcctcacctcaggacacaagaccatcatctaaaagggtgggggcctgggttcttacttcgtttgcaaccctgccctactggattccttattgaacgctaccagttctagccaccagtcatacagcagcttctgcctgggttttgactcccaagttttggtagaggccaggtgctgaaggtgggacagtgctcaggcccccctggatatggaaacccctagaaagtggctcacatcccagcaacacttgtatgagtggggctttttaggttgtctttgtcatgtagcccatgctgtgcttgaagtcctgcagtcagcctgaatgctgggattacaggaatgtgcctcacttttgtttcagctatactcttttgcagtattggctatttagagggtgtttgttgaagggaggatagagatttcacaggtgttctgctaaattcttttttgtttttcaagacagggtttctctgtgactctggaggctgtcctggaactaggtcttgtagactaggctggtcttaaactcacagagatctgcctgcctctgcctccccagtgctaggattaaaggtgtgcgccaccaccatctggctctgctaaattctataaaaggtattgtttatcccctacagtctcctagaagtggtgatagatcatcctgttaacctactggaaactgacatatttgtccaaactcatgtcacttgaattatgcaaatctccacttgcaatttgactctgaagtactgctcctggattttgagtctcttgggctttcctcttctgtacattgccagtgttctttgacttcctctaatgcccgtgcctctacccttttcctttatggaacctagcatatggcatcaccatactctgcagcagctccactgtactatcttcagtgaccagagtcatcctaccctgtccagccccatttggtctttttcttcatgaatcctaacctggacaatggccatcattccctaccctgccaatttagtccacatcttctactcctaatttttccatagtagtctgaactttaactcagatatgttcaacttcttgacattctaacaagaggttaccatctataaagaactatgtgattaagttacataaagggaaataatcatgtttttaaagtaagcttgtaattttgttgtaccacattcacagccatctttgactggctgcttgctggccctttttcatattactttgatttttaaaaagtttcatggttactataacaaatatacagtctctgaggacaaaagagggcattgggaactggagttagatagttgtgcgctgccatgtgagtactgggaatcaaacttgagtcttttctaaactactgagccaccttaccttttcagccctagactctacattaatctggtctctttcatattatgcaccagggctttgctgttctgccttcctcccattttttgagatgggtctgtcttaaaatcaatctgtctttatctatttaatctataccatctatacccaggctggctatgggctcttgatggtattgcttaggtctccaaagtattggaggttacaggtatgtgctatcacactcagttccccaatgttcaccaatatgaagttgaaaactatcgtttaaatcactagcagataccaaccagtcatcaaaattgccccataccatcccctaaggaggcccaccaagaaaagaattggacagaacatacataaacacacaaaagtaatggagcactagttacacaagaggcactgatccttgctttattcatgaaataataaccaacattgggaattaggggcagaggtacaaaagaatgaaaaaaagaaaaagaaaaaattgcagtcataacagttgtgatcaacatggcagtgagtggtggcaggcagttcagccagcgtatggcacgtctcttgacctacttggtcaaggggaagtgccctctaccatttcacagccaagttacttggtaacacctggccttacttgaaccagggtcacagtaattaaaaataacattgtcttggctgagtggctgttcttgggatgtttagcaagattaacagtctgatggcaggaaagtgaggagcatcatgtatgtccttatcctggtgggtgcaagtaaggcagattatagcacagacccacaaggtggaccctcctgtgcaccgatggagaatacctcgctagctcagtcctcagaagcagagctggaggtaacagcaagaccacacacgcagcagcatctcttggtttcacagccacattcaagttagtttagtacagaaaagcatttgaggggggtcttttactgacctagaacacaggttggagaagcttccttaggtgctgctacttagaccctaagatttctctgtactacacaagctttctcaacaaactaacattagtatgtcaggtataggatatactggcctgtaacaagaattccaaagacagggaacctagcacctggtagttcccttgagtgacaacagctgaagtttcagctgaagtcggtctcaactgttgtcacaggagggaaatgaggaatcggcagtgaggtagtaacaaccctcacaaaaggaaagaaaactttcattctaaaaacaggctgatcttccagccactcaagtcatatctgctctagccatgtaactcaagagaagttgaaagggaaaatggctgcccagttccagtatttgccaatactcagtttctgaggacagggagaacttgccaaagtccaggaaccaagttggttgttttgtattttgctaaattcaacgagcatttttattatagaaaaaaaaaactgaaggacagatcaaattgaaagaatcagttataataactttaatttatcttgcactttacagaagtctatgaacgattttaaaaagcacctccttaccccatcacgtttgacagttgttaaagtgggcaatgagtatgtcaacagcttgagtgtcggcatcttgcaagggtttcagatcaatcacttgccaaagaacttggcagcttttctatcttgtgtttcaactcagtggtacgtccactctgatggtaacctgtccagccaaatctccaccacacattttggaaaaatcaatggtgattagcaaattagttagctttggcacggagctgtgctcgcttgcccgtgacagcctggaagccagttttgatgctggcaacagagcatcgagaatgacaagtttcacactgtaagaaatagagtcgggtgtccttctgtaggattgtgtccggtgatcggcatgtgtgacaagtgacgtattcctctgcaagaaaaacaacacagcattatctgctagatacagtaaggcagaggctcctgcttgcccacagaaatgcacctgtctccaagtaatagctcagaggacagtttaccctagccaggcagggaagcctagctaaacagctattctaggggtaagaaaatgcaaactaagctgtctgccatgttttttggcagtatgatacaagttgaaaggacttcaaatgctccaattagggaagtttgccagatgcccattcttggtgctatctatggataatccacttaagccttaggtgagaacaggcaaggcatgccaattttaaatgttttgataacaaaagaggctgaggcaggccatgccataaccagaggcaggtctttagccccagaatcagtcagcagaggctgcatcatcttggctttctgcctcctcctcactatcattttctgtctttccctccagggtttctttatgtagaccaggctggcgtcaaactcagatctcttaagtattgggactaaatatgtgtgctaccaggtgcagccccattgctttcccaggttcattacaattggacctcctcaaaataccagtctcaagagaacattcagaatgatacgataaaattcaattatacacttactgatatatcttctcaagacattttctatttgtttctgttggaatcttcctttgattacaagctggttattaccatctatagaaccactatgaaagaaaacaaataaacccattacactttggttcattttcctgaaggagcccaattccagcaccttcatacttaatgaacttaaaacatgttcaattgtgtaggataatttctggggtgtgtttctggttcttcaaattttatttctattttttagcgacaggaattggtgtgtcctaggctggcctctgccttccaagtgttaacattacttgagtgagctgctatacttggcctcaaatttttttaaatatttctatcttttgcaaagattttattcttaattatgtgtgtgttatctgtatagagttatgtatgtgcatgggagtgctggtatcttctcttaactgctgagccatttctccagacactcaaaattattgagattggatttccttgagtagtcatggctgtcctggaactcactcagtattctcaaattggcctcagagatccacctgcctctgcctcctgagtgttgtcactatcaggcttctcaaaatttcttactttaatgacgtactcatacttctttttttgggggggagggggcagcttcgagacaggatttctctgtgtagctttgcagactaggctgtccttgaactctcagagatctacctgcctctgcctcccaagtgctggcattaaaggcgtgcgccaccgccgccgccaccactaccaccacctccacccagctgatttactcaggtttcttaatatttagtccaactttagacttgtaattgactttatgtccaaagcaaactgatcccttaactgtgtaggtttgattgcctgttcaacttaaaaaaaaaaaaagaaacttattgaatgcataccaactgcaaatatgagggaggtataaacataaaaaagttgtacattatttttaaaattctgaagccaagcatggtggtgcatacctgtaatcctggcatgtaggaggcagaaacaggaggactgccactggtttactggtttaaggcaagcctgaactacatagtgagaccctttctcaaaaatcaatatataaataaataacctaagccagacacagtggtgtgaaccaataatcccagccatcaagtagctcagacaagagagcactacatgagccgagcctatgagtttagagcctggttgggtaacatagtaagaccctatcacaaaataacttaaaattaaagcactacagtttgatagtcacatacaaaggcacagctgaaaatatactcaaattgtgagctgtatgtcaaaaaactgttacccaaaaaagtaaaactgaaattcatggtacaaactgtcagtgataaactcaatgattaaagcagctgacaaacacttgggaaagtaaagttagacattgtttgttaaaaatgataaatcaagcaaaacaaaaaaagataaatcacaacgtaaaacaaaattaagtcttacagttgaatttatatttgttcctatcttaacataaagtggatttttgcagaaactgattttcctgaggatttactatcacataccatgaattgtaatccttgatccctccctatctaggctaccctgactccaatgtaggacatttttcactgtccattaagaaatgggaattttgcccaactttaaaatatttaacccactgaccttttgttcaccctagtcacaacctgctagaattaccacacctctacaccaagtgcaggttattctgagaagtaaagaaagacttggctagcttttcttatgcttaaacaatgagtataattaaaaaccattactgtaacaatcctctgataattaagatgaatttttttcctgacacaaaagtagttcttctgaagtgtcaaatattactctttttgcacacagtttcttaccttgtacccaattctgccaataaaaatgcgaggagatgtttgggttgacgatgtaatctaaaaagaaaatcaaatacttaaaatctttcttagaaatcctaaaacaaagcagaaaccatgctgttcattatttcactgtgattactcagttattaggagtctcagtgaatagctcacttgtgcatagaaataagtagcactggctataatttcaacacccaagagactgaagcaggacgatcaaccttaatttcaaacccagcctagggcagtgagtgccagtttcaaaaacaaacaggctggagaaacagctcagtagttaagaaaattagctggaaaaaaaagagaaaaaaaatttgctgttcttccagaagatgaagtaggtttgattcccagcacacacaaggcagctcattcatctataacttcagatccaggggaatctgattccctcttctggccttgtaatcaaccatgcatgttgtacacatatatacagacaaaacacctttacacattaaaaaaataaaaaccaaaaaaataatatatgctactttgtagtttggtactcataaactatttattacatgctatttctgtttttgtttttttgagacagggtttctctgtggctttggaggctgtcctggaactagctcttgtaaccaggctggtctcaagctcacagagatctgtctgcctctgcctcccgagtgctgggattaaaggcataagcctaaatatctaaaatcgtgaaagcataactttaagatcatagttaagctatgattatctacctaagtgaatttacatataacctttcatttttgtactgtatcttttctaatttctagtgaatatatactattgctgccatcaaaaaagtaaagtatgctgagtaataaaaatggattacctagccgggcgttggtggtgcacacctttagtcccagcactcgggaggcagagacaggtggatctctgtgagtttgagaccagcctggtctacaagagctagttccaggacagcctccaaagccacagagaaaccctgtcttgaaaaaccaaaagaaaagaaaatggattacctgttctgtaacaagcaagtatgatttatgaaattgaaaaaccaacaataggataaagtgggtggctggagaaaacttgccagaaagggcagtaaccccagcccagggtgcaatggtgaataaaaactaaaaatctcatccactgggtcctaacaatccaggaagcttcaattcagcttagagttcactgcttacttggcaggacaacccctggcttgagaattatatccagtctcttcattcctgactctgcttaggagctactccatccccaacccaccatgtgtgttcaggtgttttgcctgcatatcatattccctggaactagagttatagacagctgtgagttgccatgtgggtgccagagtcatctctccagcccctaggatctactctcattattcagtattgacttacctttagatgccaatataaaatgagctctgataggcagacatgaactgtgacttccctcaatctatgccctatgtacttttatgtactttttcaacctacagaaaaaatgaccataaaaaagaaaatgtggtattcgaaatgaatggtctccactagctcacttacagtttacagatatctgtaaaattgacaaaagaagttttcttggttcctactcggacaacctgtggaggtttcataacaaatttcctcttctctccagcaaccatatccggattcttttctctcatgatgttgaacactcggttcagcaactataaggaatgggaattcaatcacatccttagtaatagcaagagcataaaacttctatttgggtcaatttgccttaataaagctattgaaagcagcagttcattacttactaagatctggcctttatggatgatgctcagttactctactgattttacaggaaagcatgtgacacaggggaaaaactgaagaaaccacaaatgagcaaactccagactaccctgacctcaaagtggacacttgtcaccaaggtcccactgattcccagagggctccatactatagtgacagccacactctgagcaggctgccccataagttggtatcaggaattgccatgcactggccacatggcctactataatctggtttatctccaatctgtatctcagtggctcttccaatgcagggggatctatacctacttttctctgagctcaaatgatagccaaaaagaaaaagaaaaaaaaaaaaaagattttgtctcacctcctcatatgtatagtctctttctgagcctgcccaagcaggcccagtctggttactgaatgaaatgccatcgtcttttttgctgtcttcatcttctaaagctagagataacaaagagtacgaatgagcagtgggctttgatccaacaagggggagttcagaactagagaatgaaagctacagaaacttcccttccctttcaaagtgatagctgcagtagcttcaagtacaaagggaccacacagagaagccactttcctttatagacaaaaatattacacttcacacaagatctttaatgagacatccatgataacagtgaaatgtttcttgacaaatacaagacaagacattaagtacttaaaggagagtccaattgttttcaaacctttgagaaaattgtatatataaaacccatctgtttaactatgctaaaaaaaaactttttaaaaacctatagcatataaaactataaacattaaaaattttaaatacttaaaactcaattacactaattttcctgtgtgaatcagatgatttttctgtatcatttttatcatactttaataaaatgaaattgtttttgtctagcattatcaagttaagacactcttgtcagatttcattatcatgcagtggaaataaaaggcaagacaagtattttctaaaagctcctcaagctagtcaaggagacccagatcaaaggcttatgtaacttaaaaacaggatgttgagttcccaacattaccttcgtctttttctagtatttcatcttcatctgggaatttgacattcttctttttcttctttttattgccaagcataatatccaggtcatcctctggctcagctggctctggagcatcactttcaatcttaagatcctaagaaattaaagtacgtctcaatattttgatagtagattttttgttgttgttttttgagacagggtttctctgtgtagttttggagcctatcctgacactcgctctggagaccaggttggcctctaactcacagagatccgcctgcctctgcctcccaagggctgggattaaaggcgtgtaccaccaatgcctggcttccatcctgtattttattcatactaaatgtttagaataggtaaatctacagaggcagtagattagcagtagctgaggctaaggttggggtaactgagaagaactagaaagtgacaaagatcatgggctttgttttccagaggatgtaagtcttcaaatttatgacagttacagaactctgaatctgctaaaaatcatttactttaaatggatgaattatatggtaagtgaattataccttaataaactttcttgcttcaaagtggtggtttcaccactgcatttgcaggtatacttgttttgccctcaaccgttctccatccctttaaatttctaaatatgacagtgaatggaagcaattttcctgacaccaaatatataattatttttttgcacatttctctaactctgaaatacaaagtaggtataatacttattacttggaataattaatcagataccctatgtttaaaacttggctttatagtttaagggctttcacttcagacactagtagtttcacctacacttttgctaagctataaattcaaagaccttcagcctatattgagtaatttgctaaaactcacagctctcagcaaagttttattgatatatatatatatatattgaggaatagccaaatgaaaataatgcatagatgaagctatgaggagtagggagttgagaaggaatcaagaaaagccaagtatctaaacacgctaccctatcatcacttctgtggggttaccaacctggaagttttgtccacattgtccatccacagaagtagcaggggccattcaaagttccaaaccttaataatggatcttcctagtgtctaaccatcccgagagactatacggacaccagatttctcaagagcaaaagatatgtattacctttgaagactgcaaggttttcagaattgaacgtggggtaccagagctaaagacctaattactttttattatatttatcacatcagcttagaaccaaactatgaagaagttaccgggcatcagttcaatagatgatatcatgaaagagggaaagacacaactcatggggaatcagtgccatgtgacgaacggatagacatgatacagcctgactccaaggttacttgcttacttgctgtaggcttgaatgtgaaaaaggcacattaagtcctaagagatgaatcataagctccacaaaagaacagaggctcagcctgtttcttggcttctagtttctgaccagcttatcctgctccctaacccaacatgatcacaattacattttttgtgtgtctatgtcttgaatgattatttacaatggctatagtaataatttcacagatcttagcagataaactcaaatagacagggataagtaaaactcaaacatgatatcttaaatctagctgtgtagttttagtgccatattaattaactacacgatactgtataggagatcaaacagtgacctagtctctgtgatgatgatcagtaaatacatacatcagcaaggctgtagtcattcacactgtctaactaggatacttgtaacatccttttagggtataaccccagaagcagagaaaagagtatcacagcatttaacagaaataggaacccatcagtaaccttttgggacaaaagctactggaggaaatcaaccaacaaaagtattaaccaagattacaatcatttaacaccaattctaggagagtggatgccctcttccagcctctgaagacactgcatgaatgtggtacactatcacatcaaacacccatacatacaaataaaataatccccccaaaatattttttaaatagtctaaattatccttgaaatacacctctgggggaaaaataaaacaaacaaaaaccaccaataaaaaaatcttactcatttcaatgcaaagtaagcacacagactcaatttgctgaatggattgtcatctaaactacgaccttgtttccaaacagattactgagtaaattacttattacatgcaggcaatacttcacttacttgggtttgagcatctaccaaagaaaaacttcagtacatacagtaaaacagagcccttgatatgtgactgttttcttttcaatatgaacatattttgtgaatacacagacacatatacacacaaaattactatatgctcattttataaataaatgtgtgggctttgttaaagtgatttctgcatagagcctctgtgtatgtgtgtgtatatacatgtatgtatcagtatacacttgtccatgtttgtgtgtagagagaggcccgaggttgacttttggatattttcctcaattgcttccccatgttatttttttgactgtctggactaacagtcagtgagtccagggaactacccctttccactctgcccagggtcagggttacaggtgcatgctggcaggcagggttttatgacggtcctggtgatccctcatggttgcccagtatctttaaaatggtagctcttgagcaaagaagaaccatctttcagctactttgtttatccatctaccctcctattcaccttcctacttaactacctacattttattcaaataattttcagattttgtattggaaatcaatctaagaggatgacaatcacagggaatcaagtccttacaagatcatatcagagcactctccacagaatttcccagagaagcctaattttcttattgaatctctgccatcagctaccaacttctgcactgggggacattctttgctggtactaaaatttctcagtcacagagacacctttccttagctcaacaattttaacatggttaaaaacaatgtgcattttctgagtccattttaatgacacaatacaataagacctaaatccctctgaacacagacacgcacgcacgcacgctttttttcaaaacagggcttctctgtgtagccctggctgtcctggaactcaatctgtagaccaggctggcctcaaactcagagatcagcctgcatctgcctcccaagtgatggtgaaggattaaaggcatgtgccaccactgcctggctcctattataatcttttataccatgtagtcagatacattcctaggaaaattaccttaatagtggctaaatgctaaacaaccaaagcaaagctactaagagatgagatgaaggaggaaacagctattagcagcctttctagaattccaattttaccttcaataagaaagctacactacctttacaccttcttcagcttcatcaatgtcaaatatcttttttgtttttttcttctttttcttttgattaaagaagttcaagtcatccaagtcatcagatgcatctaaaaatagattaaacagatttccagttattaacaattagaaagcaaggcaccaaattatgagtcacaccaactcttttcatgtattcttatggtgtcctactgctaccaccaaagttatggttctgaaaacaatgacaaatcaactcaaagctttctagaaaaattgttaggggccttggctgagaacatcaaactcaataatctgaccatgtaatgacagaaagtgctctctggcacaatctccagactatccaactgtatctctttacttccctctgttctcaccctccttctatccctcaatctctggctccagctctaccaaagcagtggaggaactaaggcttccacaacaactgtgactgacacaactactcaccctttttcctactgtcttcttcatcagcttccacatctttgtcttcagttggttctggctccacttcttttgtttctgagggctgggtttcttctgtctgggcatcaccttcttcatctaacataaaaggcttcttcttcttctttttctttttgctcatagtaggatcaaaaatcatctgtttaaattaaaaaagaccaagggattattttcaatgatgctcacattccaaatatgctttattctttttcttcttccttttttcccccccaagacagggtttcctggtgtagctttggagcttgttctagaactagctcttgtagaccagagatctgcctgcctctgcctcccaagtgctgggattaaaggcatgtgccaccaccgtccagctatatgctttattcttaaaaaactggatacattaaaatcccaaaagggggtgctgggaagatgccttaaattataaagccacttgcccccaaccacttgcttgtttgcacactttctaattcaataaaagacaaatacagataaaagacaaatacagacaacaaaaatacaaaacaaaatagatttacaaaaagtccatctaccctcttttacattattagacatggggagtacctcacacatgtcttctaatttataagtcagcacaagctataaataacttcatttttattttcatgagcaaatttggacctgaatgaatcatgaagtttagggaaaggaccttagcaataacctatgttgcatttctgattgatgggtgagatcaacaatgtctaggcagataatctagagtgactaagaccaggtgacctgagtcttagtttttaaaatttttatctgctgagtagtgtttggaggagctggaggtaaatacaatcaagatatattgtaacatatatgaaattgtcagagagtctagcagtggtggcacactcctttaatctcattactcaagaggcagatctatgtgagtttgagggcagtctgcagagtctacagagtgagttacagaacagccaggactacacaatgaaaccctgtctcaaaaaacaaaaaggaggggatggagagatggctcagtggttaagagcactggctgctcctccagaggtcctgagttcaattccccacaactacatggtggctcacaaccatctataatgagatctggtgccctcttctggtgtatattcatatatgcaggcagagcactgtgtacataataaagcttaaaaacaaacaaacaaacaaaaaggaatcaaagagtaaataaaatattgaagttcactgcaattttaacttttaagaaaacctaaaaacaccaggcagtggtggcgcacacctttaatcccagcactctggaggcagaggcaggcaggcgggtctctgtgagctcgagtacagcctgatctacaagagctagttccaggacagcctccaaagccacagagaaaccgtatcttgaaaaaccaaaagaaaaaaagaaaaagaaaacctaaaagtaagaaaaatttatcaaattctaataactttctacttgtaagaaaatttcctttattgtttttgttatggaatgtgaaatgttcacaagctatagaacaagtgaaaaattaatttctaaccagtagattgtttgcaatgatcccttgaaagagtttgaacatatagggcatattcctgctattgaagaaagcaaagtctttaaacagaactgaatttgaatacaattttttttttcccttccatgcttaaacttagcagtttgttcatcgtgtagtggccaaaagcacaggtctggagcctcattaccttgagtccaatcttgtctcaaaacagtaaaactttaaaatttttggcttgaacatttctgaattcctgacaccattagggaatcttccccttctcatcaaggaacattcacattcctgtgacattttaaaggtaatgcttttgctaggctaaaaggaatcatgttttactgagtttggggcttaatttccctgtgtttttttttaatgtgtttactttatatcaagaaatcatttaaagaaaagctactttttaaaatagactcttattctctatcctgcctaccagtcagaataatccattctaatgagatttataagtcacttccaagtacagattttcagttaatccttaagttggcagtcataaggggtttgcctgtgacacttctctagtcaaagcactaggtaaaccagaatcacatcccatgttcatcccccctctctatcagtaaattccacctgagaataaagccaaaggaaagggttctggtacccttcaatttactgcatggcctaacctccttgggccctaatttttaatttataagtctaaggatcaagctacatactttagatttttcaagagactgctgctggtatgaaagctgtttccaccatctctgcttgatcaaatcatgttcattctctagaaatgaattcttaccccacacctttcaaaagatctcattataccaaaaaaatgacctctcaacccccccttcatcactacaggtgttagctattacctcttcctacatacaccacaagcactttgccatagatcgaatacagcagtttacaggcagttatttttaagttattaagtttggaacatgagtagaaagaaaacaagggtgaaacacttcctctcagaacttttctaatgcatacataatacagcagctaagagcaatgtctactatctctttcaagcaagaatcatctatcatctccttcagactgaactacttagtaagcttgtgagagcctcctggtccatttacatggaggcagtatcgcacagatctgggattgtactactggctcagccacttggaatttgattataggcatcgtacaactctagttttctcatttctaaaatggaccttatttaaaggaactgtaaaaatcaataaaaaataggatttcgtttcctccagaatcaatctcaaattcctcaatgcagttttctaagccctccatgaactagcctgtgtctgtttcaaccaacctggtgaatacttcactttctttaagtactttttcctttcttgaccataaatgccttgtaatccattttctcactggttgagaaaatcctgatcctctctagagtctactcaaaagccaactctgtagcgagcccccaactgttcctcttgcccctccaactgtaacccctttttaagtcgtttaattttatgtgaactaggataaatcttggagggcaaaaagttaaaacaggaaagggggcttgattcaagcccggtggagaaaaacccagtcagcttcgaagccggacttccctgctcgcttcgcgtgttaaaggaaacttagggactcgcgcccggaaactttcctggaagggtggtcaccttttaagactaaaatatcttttcctctggccctcacaccgtgtctaagaattaaagtctcgagcgaggaaagggaacgagattcgcccggaaaggccagccgacaaagtttttaaccacggtactccaccggaaccaagggaagcttctcagggcacctgagcactgggcaatgagagctgcggcggcagtgtctgaaaagatgccggggccgccggccctaactgggtttaatcgtggaaactaactcggaatccaaaccctttcagagagggcgactcaacgtgcttcccattccgaaacgccgatcaccgtaggaggccggcctcgacgctctcgccctgaggagagctgggtgcggccaaggccgaggatccggagtcctcgtcggctccacagctccgggccgcttaggcccggctgctcctccacatggcggccgcccaccgctaggccgcaggcccggcttcccacaccggtgtgggttcggcttcctgcctcagtcctcagctctagctcggtgctcaggctctcacctcgtccccggacatggctgcggttctagtgggttcggcaagggtgggacgtcagaccggtcagcttcagaccccggactcggcgaagctcctaccgacagctctcccaggcccgcgctaggctcttgcatcagcgaaagggaacgacaccccgccctcctcccaaacgttgtaagtgcgcctgcgcagaactcgccaacgcgcaggcgtgcggcagagagaacctcgcgtgttgcttgtggcgcgagttaccaggcgacatcccggcgccgggcatgctgggacttgtagtttgcctagaagaaaagggcgcttgagctacagcagtttccgaggccgtgagcgactgttttagcgccagtcaggaggtgcgggttcttgtgccgctggttacctcagcggttcgggaagcgctgaattgcttgtagagtggatttggggccattcttccggagttaggttagtgagactctgtaatgtgaacccgtgggacttattgcccacatgcccctggggtgttctggcattcgaggaattctaagggagctggaggcatgcacctcattaaaggcgtttttacgtcgtgagcagttttatgttgctggctttttacttcagaagtatcttccctggttcccctgaagtaaaccgagaaacagccctgtcagtctgccaggaagcttcgaaatacgtcataactcgcttaaggaagggatatgttgagaaatgtgtagagtaggtaattaacttgttgatgaacctcacaccacacaaggaaaaacactacaatgtcctggtagatataatctgggaccgtggttttatgttctttttggcaaaagcttcttggttttgttttttggttttttgttgttgttgttgtttttcgagacagggtttctctgtgtagttttggagcctatcctggcactcgctctggagaccaggctggcttcgaactcacagagatccgcctgcctctgcctcccgagttctgggattaaaggtgtgtgccaccaacgcccggccaaaagcttctttacatgcatgactacttgtttatgaagtctttgctagacaattctggatgcatcacccaatttccctggggagatacagctgccacttagagaggtctcattatctccagtgccatccagtcaaagatcatggagggccaggcaatggtggcgtatgcctttaatcccagcactcaggaggcagaggcaggcggatctctgagttcaaggcctgcctggtctacatctcaagttcgaggccaaacagaactgttacacagaggaaaccctgtctcaaaaaccaaagatcacagagactacccttgtagttagacaaatcaggcttgtgatcacaagaaacaccaaagcatcactgtctgaaagaatgcagtctggacttctcaggtgattgaggggatttaagcaagcagatgctatcaagaggtgggagtaattgttggggttttaatgcttctgcataagagtcaagagaggattggtgaaaacccctcatagtacacggggaatatttagttatttttgtggttggccctaatattcttggttttatttctgtattcatacatgattacagggtttgttcgtctctctctcttttttagagatttatttatgtatacagtattctgcctgcatgtatgtcttcaggccagaagagggcaccagatctcattatagatggttgtgagctaccatgtggttgctgggaattgaactcaggacctcaggaaaagcagccagtgctcttaagcactgaaccacctctccagcccttgtcttttttttttttttttttaatctactgaaatcatagagtggtctgtctaagtttggcatggtagcacttaccgtcgtcgcacttgggagataaaggcaggaatgactctgcatgaccagcagagagagagagacagacagacagacagagacagaaacagagacagagagagacagaagaaaaagagaagaataagaaaaagatcttcttagtgtcttttacaaatcactttgctatgcactaaacttatcctaaaaataaactgaattgaaacagtgttctatgaaattatttaattcagcacaccctagatgataatatcagcattccccccccccactatccaaggctattctctttttcgttatgatccataatgctttgggctttaaaataactgaaataacccacaaatatttagtgccccctaagcatagcatgtccttgcctcagaagagctataatttagtgagagagatattttattagtttccttttttggatgaagaaactgcttggatagcataggaaaaattatccacacttatatatacagacaacaaaaaagagaacccaggacaatttgatactggtggctgctcatttaccttgaggatttgagttgctgctgccatagcatagtcttctttagctaccagcatctatgtgtgccaggatttcttaccagcaacactattagcactttggaccagacaactctgttataggttgatgttctcctcactgaggacattcagtgcctggtctatattcatagatcctagtagcacactccttccagtcatggcattgccaaatgccaaatgccacctcctgggaggtggggtaaacatcacccctgattgagagctactcacatcttgtctcttcctgggttgttgagctagaacaagtattcttggctagtcctcaacagagttgggaggccatgaagaagagagaagcaaactggactaagtttctgaaaagcctgttcattcaatgataaaaactgaaaggggaaacgaaaggaaagatgatagaaatggagaaaggtaatttacaggaagtcaccctttcatgatttagttcatgaaagttagttgatcctaaaaaatatactaaggtggttgtgctatccagtttaaggtcaacttgacccaagctagaatcatctgagaggaaggaacccaactgagtaaatactcctaagattaggctgctaggcaagcctgcagagattttcttaattagtgattgttgtgggagggcccaaaccattgtgggtgtcacccttgggctggtggtcctgggttctataagaaagcagattgagggctggagagatggctcagaggttaagagcactgactgctcttccagaggtcctgagttcaattcccagcaaccacatggtggctcacaaccatctgttatgagatctggtgccctcttctggtgtgcagatatacatggaagcagaatgttgtatacataataaataaaatcttaaaaaaaaaaaaaaagaaagaaagcagattgagcaagcccacatagagcaaagcagtaagcagcactcccctacggcctctgcatcagctcctacctcaaggttcccagcctgtttgagttcccatcctgacttcctcagtgatgaactatgatgtggaggtgtaaaacaaataagcccatttctcccctagtggctttggtcatgttttttcatcatagcaaccatagtactaagtatggcagcagtcttcatcaggccttcttgtccctccactccctatttgggagatattggtatacatagcaaatagtcaaatcactttgtgaaaaagattttcttttcagcatgatacccagtgtaactatcctcacatgtccacttgaaggaaatcttgcttcagagatttcatctttcttccaaggagtttgctttccaagaaaagccaggatcccctggtgaactagccaaagtcaccaagcaatgatacctaagcttttccagttttctaagagatagaacccatttggcatcaacacaaataatcattgtaattttatagcttgttttatttagcaatcactataaaacgtataaaacacagccgggcattggtggtgcacacctttaatcccagcactcgggatgcagaggcaggcagatctctgtgagttcgaggccagcctggtctccagagcgagtgccaggatggggtccaaaactacacagagaaaccctgtctcggaaaaaaaaaaaaaaaaaaaacaacatataaaacacttggtaattttcaattcatacctatgagggaaatcactatagattttctactttctaaatagagaagccaaattatggactctacaaaagtagtgagaagtcttgaagtagtctactgggctctttactctggaccactctttatgcctagtgtcaacccagttcttcagctactgaatggtaagttaatggtgatatttaatcaaccctatactaaagtatgtttttaatgcccttggaacagtccttatattattccagatcttggggtaccccccaaaccaccatggagtctgtactcatatgcaaaagcaaagagcctttgttcaagctcaaggttggactctctgtctgtccaatgtcgtggttgagagcagaaagtgcccagcccaggctgggtaaggtgtttatgatagtagaagttgagggtgaggtgattgggttcaaggccctgattggctgacaattgtctaggggtgtcttggtgaaaggggaataggtgtgtgctgggcttgagaacatttggtgatcttatctaatggttgggatgtttggatgctgaccctctcttgatggtgtcagcttatgccttttcctggaacctggtgctgcctgccagtaaactgaaactcatgcctacttttcagctcacttttattaagcatgccatgacagcaatgtgcccaagctcattgggctgttctgggctccacacttattctcttgagttgaccggtgtagtatagctattttctccaacctgaaacatgcccttgtagatgagtgagtgcaagaagctcataggacttgaggagttcaggaaaaatacaagtctctgatagcactacaaggtacaaagcccctcccacaaagttataaaagcaaggaatcatttctggggagaggaaacttactgtgactccaagctcttcagggagctccaaggatatagcttttgtgagtgcacacccatgttttggtagtcttttcagtgacacagctgcctatgagtcaactacattcttgtaaggaacgtcaatcaacttattggttcaacaaaccaataagtgtgtgatcatttctttgttctgtcattggagcccatttggattgaatagacattgttcatgtctctccaggaaaagttacccaacacactcacaaaaatagcaggtctgtagagactatgacttcaaattgtgacagtatttgaattagaaccaagatcttgggaagcttgctgggtgtggtggtttgaataagaatgatccctagcagggtagtggtggtacagcctttactcccagcagggtggtggtggtgcagcctttactcacagcagggtggtggtgtaagcctttactcacagcacttgggagtaagtagatcactgagggtgatctggcctacagagtgagttctaggacaaccagggctacagggaaaccttgtctcaaaaaagcaaacaaaacaacgaaaaagaatgccccccccataggctaataatagtcattagggagtggaattgtttggaaggattataaggattaggagatggtggcttttgtggagtagggtagcctttggaggaaatgtatcactggggatgggtttgaggtttcaaaagtccatgccaggcccagtctctctctccctctctctctctctctctctctctctctctctctctctgtgtgtgtgtgtgtgtgtgtgtgtgtgtatgtctgactctatgtctctctgtctttttctgtctgtctctctctttgtctctctctctgcctatggattagtctgtaactctcagctactgttcgagcaccttcctgcatgccaccatgctccccaccatgatgataatggactaaacctttgaaattgtaaacaagcccctaattaaatgctctctcttataatagttgtcttggtcatggtgtctcctgataacaacagaacagtgactaagtcattgggcaaactaatcacctgagttcaagcctggaactgactcctaagactagtcctctgacaaaaagtgcactatggcacatgggtgaccccccacaataatagtaaataataataaattaatttaaaacatggtttttagtctatcttttgcttagtaagtaaaaaggtttttggttttggttttggttttttggttgttgtttgtttttttttttctctgagacagggtttctctgtggctttggaggctgtcctggaactagctcttgtagaccaggctggtctcaaactcacagagatccacctgcctctgcctcccgagtgctgggactaaaggcatgcgtcaccaatgcccagcagtaagtaaaaagttaaatatcacccacacatcttagaaataatggcaaacataaggtagtgattctaccccacatagaaatctaggcctatttacctcattttcattgtgaatactgcattgtatggggactttaaaagttagtgttggtgagaaaagaggaaagtcactgaaacatgaatggaaaacatcttgtaactacaagattaaattaatctttgggttgatcttgacagaagaaaaagtgaggctcctcacaagaagccttggataaggttattttatttttattatctatctatctatctatctatctatctatctatctatctatctatctatcatctatccattcattcattctggtgttttgagacaggctttctctatgtagccctggatgacctataactgttctgtagaccaggctggctttgaacttggggattcacctgcctctgcttctggagtgctggaattaaaccatgtaccaccatgcctggcatgaatgggattaccctgagagaaacacatgaataggaattaattcttgttgcttactttggcttgtttgtttattgatacagggttttactatgtttcctaaaatagcctcaaacccatgatccttcagcttttaccttgaattatttttaaacatgtttacatttattcacttactgtgtgtgggggtgtgagtacatgccatacatatgtgcatagaggtcaaaggaaacttatttccaaggaggggataaaaatccattcttctattactctatcgcagcccttatcttatgatggtgtacctatctttgaggtcttggaggacaggatctgtgtactactcattttcctttgttttcccatagacagcacatatatgtgaatgaaaaactctaatgaggtgatagatatgaggactcataactaaatcaccaggactcttagattcttgaacacagactaatttctaagacgcagtggggagcttccagctgcgttctatttggaataattgagtgtgaatgtagtcaagaagaaagtgtgttttacatcctcccttcatgactcattggaaaagggactgataacattcgtaacagaccagtgggctctggaaggagtggttcagtttaccttgtacacactcggcaccttagattgtcactgttcatagctcacatagctcccttgcttttgattggcaacccccagactctacacactgcccagtatgtattaggaattcagtgagtggaactgaaagaatgttcaaattaataagtggaataaagaatttcactttctcttatcttaggtcatttaagcctaccctctcaaaatgattttaggcactagttccttttatagctctttccttatcaacccagcctaccacaatttcacccttttctgttatgatttaatattcatcaatattattggataggcattttaattctttttgcaattttttttaaagaggctctgtctgtgtagctctggctggcctagaacccactatgtagagtgggctggccttgaactcatggataatcctcccaagtactggaattataggcatgtaccacaatgcctaaccaatgcattattattttagactcatctgtctcttctttccaacaaggttataaaattctcttattttcttctttagttttttgaggtagagtttcatgtgtcaaaagtatgccccctgaagtgtcttaaatctagtaggattgcaatgttataaatagttggtagtatccagggctacttaaagttttgctatcttagcagatgatttttttgtttgtttgtttgtttgtttgtttttgaaacagggttcctctgtgtagctttggagcctgtcctggaactcactctgtagaccaggctggcctcggactcacagagatccacctgcctctgcctcctgaatgctgggattaaagatatgtgccaccccccccaccccaccctcttccatcttagcagatgatttgggttttttggggggggagttcgagacagggtttctctgtggctttggaggctgtcctggaactagctcttgtataccagtctagtctcgaactcacagagatctatctgcctgcctctacttcccaagtgctgggattaaaggcatgtgccaccaccgcccagccagcagatgattttttaataaaacacaataagattctcccttatagtcattagaatggtcactatgaaaatgaaactgaaagactcacacaccaaaaaatgacaagtgctagcgataatatggagaaactggaagccttgtacactgttgataggaaggcaaaatgccgagtctactatggaaaacagtaaggctattcctcaaaaaaaaaaaattaaatagaagtaccacagggttcagcaattctgcttgtttatatgtatccaagagaaccaaaagcagagtctacacccatgttcatagcaacactatttacaatagtcaaaagaatgaaacagacattccatcaccagacaaatagacaagcaacaatgtggtgtatgcttatagtggaatatcactgagctttcaaaaggaaggaaattgtgctgtatgtgacaacatggataaccttgaggacagtctgctaaaggacacaagccagttataaaaagacaaatactggggtgctggagagatggctcagcagttcaaagcatagactgcccttgcagaggacctgagttcgtttcccagcccccatgtcaggtggctcaggactatagataactccagctccatggcatctggtgctctgttctggacacacacacacacacacacacacacacacacacacacacacgcgcgcgcgcgcacacactaaatctttttaaatgattttttgaaattatattataattacataatttcccccttctatttcctccctccaaacctgcccatatgctaccatccccactctgctagctctcaaatttatggtttctttttctttaattgttacattattatgtgtgcatgtttcctaaatacataagtacagcttgctcattcagtataatgttatttgtatgtatatgttttcaaggctgaccatttggcattggataactaattggtatgctcttctctggagaagacctgttttcctgctttcagtatttcctagttgcctgtaattctttgtctaggattgagatttcaccacccacattagcttgtccattggtgccctccttattcaggtcatgtttaaacggtcatattggtgagacttcatggatgtaacttctgattagatatagatatagatatagatatagatatagatatagatatagatatataagagatacaatatcacaacaaattccctgttcctctggttcttacaatctttctcacttctcaatgatttctgaacttcaggtacaggagttgtgtggtagatatatcagttgagactggggctccacaaccctgcattttgatcagttggggttttctgtaatggtctctgcttgttgaaaaagggaagtttccttaaagaggggcgaggactacatttatctgtgggtataagtaatgcagttagggattatgcaggttcagtaaagtggttgtaggttcttcaagatccatgactcgatagtcctaggtagttggccaactttccagtaccaggcatgatttctttcttgttgagtgtgtcttaagtgaaaccagagggctgtagtttaactgccaaggcatgaatgccactatcgtacccttagacacagtgcccagagtcccccaagctggatatgacacgatagctttctcaaggactgactagctttcatgttaccaaaaggtaccatgcaagtttccaaaggagagaagcaaccaacagtcctacccagctatgacaactatgaaccataacaatgacgagcacagtgtgataacaataaatcttttaaaaggacaaatatcttcttgaaccttttatatgagttacccacagtaataaagttcatattggttgccagggcttgataggataggaacagtgctagttaagatacatagaatttcagtatgtaggatgaaaagagttctagaattttggataagaaaacttaactgtgcacttgaaaatggacaagatgatatagtatgggtattgtaaaacattaaaaaatcaaatttattttatcattgtattattgtatatccatgtatgatgtgtgtgaattgtgtaaattcaggcatggatgtgccagagcaggcatgtgacagaggacaattttcaggagttggctatctccttccatctttatgtgggttctggggattgaacttaggttattaggcttgtatggcaagtacctttacacactgagccatcttgctgacccttaacactctcaaaagggcacagaacaagaggctggaaagattgctcagtttttaagagcatttgcttctcctgcagaggaccagagttcagttcccagcacctacattaagtagcttacagttgcctgtaagtccagctcccagggatctgtgagtgtccagcacggacacaatgtgtgcatacacacagaggaatgaattatatatgtatatataaaattatatacatgttatacatataattttaaaaggacacataacaggatgtcaaaaaaccacagtttcagttcttggttattcccttctctttactcagtgtgcctgttgcttcacttaaaatcaggataatatgcctgacagttctggtttttataaagatcatataaaaacaaacaaaaacaactcttatggcaatgttttgattagtagtttttacagcattccagcatttctagtcttacactcaagacaagtttcgcgtcttatttcataatgcaatgttcctaagggtgcctcagccaaagtttatgaccacttcaaagaatatgcatgcccaaccccctcaatttgggctatacaccttataatttggctctaggacagcaaataaacagcttttatgaagaccattgatgatctaagatactaattatcaatgtggtttagcattaattgaggaaatataaatccaggattctcatgttaatgttcaaagagctagccccaaattaggaggctaagagaaagaattaacatctgttgaatggcagttaagtgtcaggccccagagcaggtatgctacctgtgctatttcctttagtagccactataatcttttcaggttggtaaaacagggaacataaagttgagagaggttgtcactaactcaacaatgaacaagaggcagagatggacttaggatttaggtccaaatgactgaagcctgcactctttctactatcttacactgcctctcaaaatatatttctctatccttagttacatagagttcatgataaatgatatgtatttgttacacatttatgtcaattatctgacttggtcaaacaagtaaactagactgtgggggttgattagcactgctttagaggtgaggacacaggcagtcaggcaagcagtaagcaatcagaactttccttctctgaatcagcctcctgggagcagaatttcatttctgtgtttcactctagttttttaataggcatgaagtctaagtgtcttgaaagccttgcactcttacggtgtgtgggcagaacaacacacaaactgcttcttgcttatactcccaaatcattaaaatagctgtgaatgaatatagttttttttaatatttagtttttagccatgtggtggtggtacagttacttataagatagtggtaataagagttggaacttgctatggagaccagactagcatcggacttacaaagatctactcacttttgcttcctgagtgctgatattaaaggtgtgggacactatgacagcccatttttaattttttttttttgagacagggtttctctgtggctttggaggctgtcctggaactcactctggagaccaggttggtctcaaactcacagagatccgcctgtctctgcctcccgagtgctgggattaaaggcgtgctccaccaacgcccggccatttttaagttttttaataatgagtatatgtgtgtctgagtgtaggtttgtccactctagtgcagtacctgaagaggccagaaaggcattggatcccctggatctggaggtgagggtggttgtgaactgcttggatgtgggagctgggaccagaactccggtcctctgaagagcagtacagcttctttactgctgagccatctctccagccccaagagttgtgtatttcttaacagtgatattggtcaccaggagacaatgaagcaagtattttcataattttgagaggaaaattgtatttttaacctagaactttgctcagccatatgatcagtcaagtctggggaataaagatcttttcaggcatgcaatgactttaaaaagtgtctcctccacatacatataacttttctttgggtactgctgaatgatgcatttcactaaaacaagataggaaggtaaagacctcagggaacaggatgaacctagggaagaatgaaaaagcaagtccctaagatgacatcctcacggggacagtacagtcagcctggaggatgaacacccctggggaagcattttgattgaaccctatggaatatctgtaatacttgactgtattgaaaatagcttaagcattttttttgcttaagcatttttacatttctctttcagagtctgaaagaattaatgattaataacattaaaaaatggcaaatcaaaaactggggtatttattctaagaacaacagagtaggaaatataatttgtaatgtgaataattcatgtaaaataagccacacttataaagtcataggctagaaatatcagcttaataaaaacattaaatattaatattgggaggctaaagggaaggaaatacaaaattgacttctctgttaggtcttatttaacatttgaaaatccataaattgcagtataagaaattttcttgagacagaatttcttgtattctaggctcacatcaaactttctatgtagctgaggatgaccttgaactcctggccctcctgcttccctttcccaaatgctagggttacagtcacgcatcaccacacctggtttatgtggcaatggggatcaaccctggggcttgctctgtgctagggaagcactttactaaaccacaatagtccctataactttaattcataggaaaatgaacagaagcaaggaagcatttcagaggacacttcaggctttgggagcccctcctctgccctcaacctccccccattccccaacctcatccctgctttaaaaaaatcattatgagcatgaacacggtagttgttctacaagcgctttgtatgttgataaacatttaacatatcaaagaaacaggagagagaatgaatgccttgagtatctttctagacctatgatatataatgtgatgatatgtatatgtatgaattatatatcatcacatttatatatacacatgtatgtcatcacatcacatatacctcagctatcagaaaataatacagtactaactagactgttttatttgaggcatcacaaataaaatttgtgtttggcttaccacaagcattgacatcccagagaaggtggtctggaaagtgccagtccctcctcagtctcttgactcatgttctaaaactgtgaactacatcaatgtcatagaggctctggaacctcaataggatgttatcttgaggtcagtgtcctaagactatcttctatgtggaattaagaaatttaggctcctttcttttacttactggccaggtgtctccagcctcccatttcttctatttatcacagacgtcattatatagtgaataatatccaaaatgaactgcctccgattaaatgcctctcagttgcaggtacgtcccagtgtacttattaggaatgattccatcttttattaaactataaaaactttaaaagcaccaactttgtttttctgaagtttcccacacactgtgactgctgtgctctacttttagtggctactacataagtgatgcttatttgttgattggtatcgtggcaaggatgtcattatatattcttgaaattccctttttagaaatgacgaaaattccttattctccaggaagatactattttgatagaaaatttataattaattaggacaatgaagaaagttttcttcctgagtggttccttaatgatttacagttctataaaaagttaagattttctttgtgagacaggtttcactatgtagatcagggtggccttgaaatcacagagaccctcctgcctctggctcttgtcttagttggagttactattgctgtgataaaaaaaaaaaaaaaaagaccaaaagcaacttgaggaggaaagggcttatttggcttatacttccaaatcatcatttattataggaagtcaggaactcaagcatagcgggagcctggaggcagaagctgatgcaaaggccacagagctgcttactactggtttgctcatcatggcttgctcagtctgcttcttatagaacccagagcttacagcctaggaggcagcaccacccacaattatcgctaggaaaatttccaacaaattgtgctgtgcttaaacactgttctgtggggggtgggtgggtgggtgaaacagtgtcagactcctgtggtttgaatcaacactagctacttagttgtattgaactgcactgccttcttgcttccatggattgtttctctgctggccatggtgtttacacacacacacacacacacacacacacacacacacacacannnnnnnnnnnnnnnnnnnnnnnnnnnnnnnnnnnnnnacacccacacacacacacacacacacacacacacacacacaaattcccgttcctgtagaggccagaggtgtggaatccctggagctggagttacagctgactgttgttagatttctgaggcagcataaaaacacagaaggcagaaaagagataagggtctgacttccaacagacagaattgtgcttattagcagacatagtgaggggcagactcactcccaagggaagtggaggggtctgctggggaaaaaagctggctgcaaccctttagaggggaggatgacgggctcaggaataaggaaagtgctgtgcctttcctgagtctctctttcctaaaattgtttgcccaaggtaagacaggctgttccaacagacattcccttcaaagacaacgaataaggatgggcaaagagtcttataggaaccctgttttaccaccaaggccctctatcagttgtgagccaccagacctgggtgctggaaaccgagctaggatcctctgccacagcagtacgtgctgttaactgcggagccatttctccaccctgtagtcatcaaaaataaaaactcttgtcctctaagccagttccttttataaatgttactgtcttagttaggcttactagtggctatgatgaataaaaacacattaactaaaagcaagttggggaggaaagggcttgtttggcttacacctccacatcatagtccatcactgaagaaaatcagggccagaactcaaacaaggcaggaactgatgcagagactatgaggagtgctgcttgctggcttgcttccccatggcctgcacagcctgcttcttatagaacccaggacctcaacaggaatggcaccacccataatgggctagggcctccctcatccatcactaattaagaaaatgccttacaaccagatgttataaaggcattttctcaactgaagatttctcctctcagatgactgtgtcaagctgatataaaactagccagcatagttactaagagcagagtaatattttaaagaaaatcttgttgctgtaggcacagagaattggattctagttttacattattttaaccctagataatcccttaggtaaatttacattttgaaacatctattaagaaagaaaaagaagccacctcaagtatgtttgtaaaaatagcataaggcatcagccatctacaagcagccagaaggttgggatgagggagctgggtcactcaagtccatttgccttcacattgtcagacagagaggcccttagtgttagggctttacaggagcctgagcatctttgggagctagagcaggaacaggaacaagagctcaagcctgggcctgggcctgggcctgggcctgagataaagctgcagcactggtcttgttttgggcctttgtcttgggctggcagagcctttcacttttggtattgcaggcgtaaacacaattcccagacttggggtgggcaatgaaaacaactccatggtgtagagtgaccaaccagcagtcaatagggtcaagatctctttattcggatacaccagcgcaggccaaagtgaggaggaaggagccgggaccagggccaaaagaagggatcatccacgtgtcggaggtcccttaagaagcttcctaaggtcaccttagacttcccctcaccacgccctcacgggtgtgttctggcacacctgtccgggctactaggaagcggagctacagtgtctccctacaccgtggagcttgtaatcatgccatttgtgatcttaggtttaacctcagactgtacaaggacctcagcatgggtgctcatggccttcacattgcttttctgaactctctcaggctccttgtgcagtacttggaaaaaaaatgatatttttctgaggaatacttggggttgaaccccttaagaaattaatatctttgtgatcagggtttcttgatgccatttctgtactgtacatttgcagaactggttgtatgtactttggttcttgaatttgaccatgtttacatggaacccacagcttttcctagagggaaagagctattttgaaacatctttacaaaatttttgaaaatagcatcaatgcccattaacagacttgtgaccaggtgtgtatatgtatttcaattgaccattaaaagatatcagcctgccaggttggtgtcatatgcctttaaacccagcacttgggaggcaaaggcaggtggatctctgtgagttcaaggccagcctggtctacaaagcgagtgtcagggctcccaaagctatatagtaagacctgttatgataaatctttctgccataagccgccgagccccactatcacatgtgcgctttatgccagccgcccgcccgagttaggcccaaatgaatacacagaaacttgtattaggttcaatgctgcttggccaatgactaggattcctcatctgttagctcagtcttaattatcataaatctatatattttataagacttatcttatcggacgtcttattggcatccctccttgctgggggatcacattgtggtgctggaggagcaaggggaaaaggggacccttcctgtttctccttctttaaatatgagtctccctgctatgtcacttcctgcctggatcaccacttctctactacatttcccagaatcttctttgactcctagtcccgtctaacttgttgtctcattggctaaaacagtattttatttaaccatcaataagataaacatacacagtacattccccatcatctcctcttttctgtctaaataaaagggtaacttgtctttgataataactgaagaaaactataaccataactatctgtcttcaactctatcaaagaccgtagaaggacaatatataaactctagaattgacaggacatctagctacctggacagtcatccaaagtccctctgtaacgttggggcatccatcttcagcctataggccacagtgtgtctagcacacttctccatttcaacaggaacccttcagtactgtcttgttttgtaaattcagcagttactttcttgtgggtcctgcatgtccagtttatacagcaacaaacggtccaggcaagagcagtttcttgcccaaatggctaatcttgccatgttgaaagcaaactccataacgagtttctttgatgcccatcctcctttctgacgtaattggtgtgccaggagcagctgtgtctcactggccaagaaaaagcaacaactatgtaaatgccatatttctgtaggtctttgaaaggtttgaagaatacctatctcaaatacatctctatatctagaaaacctaactaacctaattataagttctgactattatagtaaaagatctgtaaaaatacaatacttaaacaagaggagacatatacatatcacaaaattgaccttaaagttgtatcaataaatgaaaatctataccaatgtaaagtgttcattcctatatcctattccgcttttctttctttaaaaagagattgactatgctcattatcatttataacctactccatttaaatgaaaacaaacatttataaacaatatttggggatttgggcgtcattccctctaaactgcttcctgatgattgggggcgatgttcatataccatggggatcatgataaaacatagaaatctgaccaagtccttgttttcgtagtctgaaaggctgtatcgtctcagctttagggggtcttgcttgatcaaaccacattagtctggaaggaatcaacagcttttgattttctgtggaaatacaagcaaaacctttatttctaagtagcctgtcattagacttaaattttgaagtcaaagcattttgacttcaaatgtgtaagttggattaatttagcagcatttataatcaaatgtatggcatatagtatccagattctctgtgtattttccatctttatgtggctttttattactttatttttactttcttttgtttcttttttcctgagacagggtttctctatggaaatccgcctgcctctgcttccttctctcacaagcccatatatatttttaaacgcagtgtaaacctttagaggtttctttatctggatctgtctttatcatctcagaaatgctgagtctaaaccccagaagcgccgggatggcgcaagcatatggaagctgctccgatgcctctcagcagcccaacagtgccctgttgggctgtggcagcaggtttccctctttctctgggaaacttggggcgtggcagtcatcccactcctgacaccattctgttacgataaatctttctgccataagccgctgagccccactgccacatgtgtgctttacgccagccgcccgcccgagttaggcccaaatgaatacacagaaacttgtattaggttcaatgctgcttggccaatgactaggattcctcatctgttagctcagtcttaattatcataaatctatatattttataagacttatcttatcggacgtcttattggcatccctccttgctggtggatcacattgtgctgctggaggagcaaggggaaaaggggacccttcctgtttctcctcctttaaatatgagtctccttgttatgtcacttcctgcctggatcaccacttctctattacatttcccagaatcttctttgactcctagtcccgtctaacttgctgtctcattggctaaacagtattttatttaaccatcaataagataaacatacacagtacattccccatcaaagaccctatctccctaaatgagccctgattctgttaaaagcctagcaaaattaacaggaaacagaacacattaaattattattttttaatgctagccctctttaaattttattaaaagcagttcaatattcttagaaagtctaattgctctgaatataaagtattaaaaatattaacagcatttttattaaagtcactttaattacatataaataaatctttttgtctggtatatttctctgtaaacctcaaaaattatggatagcatttatagaggtgatcactatgtatttattaaaaacataagtgggtcctggtaggcacaggcctgtaatcccaactgcttgggtggttgaggtagcagggtcacaagttcaaggccttcctgctcatacagtgagttcaagtttagcttgagcaactcagtgagacttgtctccaaaagtttttttaagatgtattttatgtttatgcatatgtttgtgtgtctctgtgtgcatatcatatgtgcagtgcccatggaggccagaagagggtgttggattccctggaagtggagttacagatgtttgtgagccacccagcatgggtgttggaaaccaaactcaggtcctctgcaaaagcagttattgctgttaaccactgagccatctcactagcccctcaaaaagttttaaaagattatggtgctagggagatagctcaatcgaaaaagtgcttgcctgagttcaatgaccagagcctatatgtaaaaaggtgccagttgtggtggtgtgtgtttataacacaacactggagacaaggggacaggtgaatctctggggtctgtgggctacttaacaagctgcaggccagtaggaaacactatgtcaaaaagaaaaataggctggctcacacctttaatcccagtactggggaggccagcctggtctacatagagttccaggctaaacaaggctatgtagtaagaccctgtctcaaacaaaaaccagagtggatggtgcctgagaaatgctatctgaggttgacctctgcttccacacacgtatgtacatgtgcacctgcatgcacacatgtgaacattacctctcatacatgaagaggttttggaatctagtgtggtggtgcagcatttatatagtatgctgaaaaagaaagaagagaaaaataacaaaaaagaacactcatttgaaaaaccatacaaaataaagtctccaatattttcatcatgttgcatctgtcagtgacttagacatcattattccatgtagcatatcacaagaacactttttgttacaacacaaatgttgtgtctaatggcccaatgaacagagagatatagctcaaactttctttttgttagcaattctgggttcaccttgataatttcacaatgtacatacataccaatttaaaaactattcaatagtcttgcattacaaaatgtactatctcctggtaatgaattaatattgagggacaactttattatttcaagagttaaatcagtccatctcaacactgaaaaagaattgtaatttcacatggaacaaatcccagaaaccatgcaaaagtttctgtatttataagctactcctaaattcatttcttaaaattatattttatttgcttgataaaaaaattgggagcatctctgaatttttcttctcttttgaacaagccttgattttcatcatgcggcctcagattcttggctctctgactctgcgtgtgcctccaacacttccctgtgatttctgcttctcaagaaggaacatgctcaaccctgcacacacagcactattgcaagccctcccgactgcttctctgtttcagacagcctcacagggactttacaaaaccatccaagtctgcctgggcacacaccacatgcagattttcatgcttcccccacaaccttctttttataaaggtaaaactatcctcttgccaggggttcaagacacctagttttgctagaggttgaattgtaggaaaacctacaacagtatgtcgaacgtaggaccatcccaagtgcctctaagcactgtccctggaagacaaaatttctgaacttttaacaaaagagattttatttttattcgcatgtaaatatgtgtgagtgtgcaattgtggattcgaatgcagtacccccagatgccagtagagggtgtcagatcccctggagctggagttatgagccacttgctctggtcatgggacctgaactcccgtcttctgaaagagtggtatatgcttttaaccattgagccacctctccagccccatattttaataatttaatcaccctttaagtgcaagatcttggcaagctttcttttttataagactttatagcatagtcctttttctaatacacacagggtaagttcacctagatcctgaatgttacccattgtgcagaatgaatctcctataatttccaatatgaaaagaaaatttaggataaacatcatatctgacaaaatatctataattgtatatgtatcacagccttaattttaaaatttcatgtttatgaatatttgttgatatattattcccaggagacaaacacataggaataatctaataagaggtttttaatgtccattagaagtattttggttaatataaaacatgtcatatcatctcattttcttttaaatttgacaacttagaaataaaaattaacctctttctagaatttgtttttcaagaaaatgctaatcaaaataaatgtagccaatacagaattagtagctaataggctgtggatgatggttcatgctgtaattccaattaggaagtagaatttaagtctatcctcagatacacagagagtcaaagggtagcttagactatatgaggccctatctcagcacaagaaaaacagcaaattgtatgacttaacaaaacttttatcttataatcctgagtaatgctattttatataaacaaattgaactttcagtcaagcattttagcattgtccctttaaaacacttgttttaggggctggaaagatgacttagcagttaggagtgcttgctgctcagtcatgaggaccaacaagagtttagactggcaaatgcttctaactccagctctggggaatcttaacaccttcttctaggctactggtgtgcacctgcacacacacacacaaacacacacacacacacacacacacacacacacacacacacacacacaggaatctgtctgtctctacctcctaggcatgaagttataggtgtgtgctactgtgcctgagaatccaaactcaggtcttcattttttttttttttttttttttttttttttttttttttttttnnnnnnnnnnnnnnnnnnnnnnnnnnnnnnnnnnnnnnnnnnnnnnnnnnnnnnnnnnnnnnnnnnctcccgcctcccgagtgctggtgttagagttatgtgccaccaatgccctgcctcaggtcttcattcttgcataaggaagtattttactccctgaaccgtccccatagtctgtcttcacgctgtgtttcaagaaacatcaatagaccctagcttcccttttaatagatttcaaagaaattaagattaaatagacttataagtcagtatatagatttatcagtgtttaaacactcagttaagtctgaactatgtttatgactaattaagatcatcttattttattttaaatctttgttataagtcattttactccttgtaaatcttgtagcagttattttttttatcagcttcagtttttagaattaatatttgaaagcacggaatcaaaacaagcccagcaccagaccaggaacattcagccaggaaactcaaaattaatctttttatatctacattttggtctttccccagccatctgccatggtgggtggatgaaaggcccgagctaacttggggttagcttgttaaacaactgcaataaaacctcttgctgtgctgtttgcatcaaaaaaaaaaaaaatctacattttagttaggcctgaatgagacaaagtcctggaaccactagtttttctttctttttttttctgtcccaaattctatagttaatgcctacatttttttttaagctaaccaccttttcaaaggaagagaggaaaaacaaacagacatgaacagctcttctgcgttaatagagcctccaaatcatccctaacacacacacacacacacacacacacacacacacacacacacacacacacagaggagagagagagacagacagagagagagagagagagagagagagagagagagaatactttaaattagacatctaaataaatttaaaaatggcagaagtttcagtcattttttttctgggaaccctaagggtagatgcccattacacatgaaaacaactgcattgattcagagtactctcttagatacataccgtaagtttacaggttccctgagggagaggggtgcacactaagatagtatagataatatattacacaattaaaatagaagtctcctcaacactcttgtttctctgggttccaaatagttcaccagaaccccaatagctcagatgagcctcaaaagaccaacacattccaaccttccctgttatacagcaaacacctgaacagtttatttgctgaatttgctcaagcttccagattgacaatattacacatattgacctaaatggttcaacagagccgactcggctctaatgagcagcttccaaatcaaagaaagtcaaagctcaaggtgcaccgagcaaggagacttcagggcctgtagagtccaaatactcacgtctcgagtctccactgtaccagaggtagaaagtagctgctgccaactaaagtggaaaggtaagaaaaagcccctggaaaaaggtgattccagcagctgtgtggactgttgatttgctcttctccttccagggtagacctgctaagtggctgatacccaaaatgtgtctttttcttactggagtttttagaatcaaaaccgaggtcctggtagttccaacaagtgtgtttgaccctctgtcctcaaaacaccataataaaaagcagagaaatgagatctatttaatgtgacccctaagtcaggatgctaacatgatatttggcttaactagaggacaaggaatacagtcctggttagggtaatgtcctgcccatcattaacccagcaccctcttaggctctattctgtccggcaaggtggtctgatttgttagaattgtgtgaaatccttcccaggaagtcgggctcctcctctggctgatactaggatttcagcctttcttatccccttgcatgaggttcttggggaaatgccaattttgggggacgatccattgtttctcatagccaaagggaagggtgtaagtgtctctttagagtatctacattccttccagagctatgaatggctgtggccttcttgctgtcttttttcctaaattgtacttcagttccctttcaatggtatcatactcatgccagtttaaactattccaggtggaggcttctggcctttgcttttcttctgtgcatgcaatgacaccagtctcttctttatctcatgcttttcttctgtgcatgcaatgacatcaatctcctctttatctcatgcttttcttctgtgtgtgcagggatgcctcttctttgtctcatgcttctcaggttcctgatttcccaacattcagtatcactgttcttctagtagatattcttctaaacaaaaatgaaatttcagttgtttaattctttttgagtgttcttcccttttcctccatcaggttcccttttctcgtataccttcaataggacagcattttttctccaccaaatttccatcgaatatttatgattctgttatcatttgtggtaatgtcttcagcatcacagttttcctgtcctagttacagagcaaactcagggtctgactcacaaattgcgtagtttttattgcacatttttcactttaaagttatgtttcataatatttaaaagctcattaaaatttttttcctgctgggcgttggtgacacgtgcctttaatcccagcactcggtaggcagaggcaggcagatctctgtgagttcgaggccagcctggtctccagagcaagtgccaggataggctccaaagctacacagagaaaccctgtctcggaaaaaaaaaaaaatttttttttcctatgtgtagttgaaagttttctgaccctcctgtcagttcccccagctgcttatgaaataacactctgagccttaatatcaattgtttggccaatgtctcagacatattactggctagctctctcttataaattaacctatttctactaatctatgtattgccatgaggctgtagcgtactggtgatgctctggcatgttactctttggtggctacatggtatctctttgactccatcttcttttgctctataactctgtttggattttccacctagctatattatgcctggccattggtcaaaacagctttattcatcaaccaataaaagcaacacatattcacagcattcagaaggacatcctgtatcatctcctcttttctgtctaattaaaaatgaaagttttaattttaacatagtaaaattaaatataacaaaacttttcaagcaagaattacagctacaatatttagtctatttgtatttggcaaaattaaaggaaatactctatcatctatcctatctttgtgaatctaaagttttatatctaatttatcttttatcataactaaggaaaactgtaacaataacaatttgtcttcaactccatcaaagaccccagaaggatatattacctaggtaaacaggaagtgcattgcaagcagcttccaaaattttagaaatgacagagacatctggctgcctggacagtcacccaaatttcctctgcctgtcattctctctgaagtaattggtgatgccaggagcagatgtatctcactgtcaagaaaaatctaagttcttaaaatattttaaatgccatattctataggtcttcgaagtattacctattcatctgaaatatatctctgtatatctataaaatttaacatgactaagtttgactattatagatgactatctattaatatgtatttcttaactatacattacatttttaaatgggctacataaacataatacctgaaacaaaagcagaaatatatacagtataacaaaactggccttaaattttgtattaataaaccaaaatccataccaatatattcatttctgaatcacctgtgttatttttattttgtgtgtgtatatatgaagtttgcctgcaggtatgtatgtgtaccatgtgcattcggtgcctaaagaggccagaagagggcatcagatcccctggaactggagttacagacagctgtgagcctccgggtgggttctgggaactgacccctgatcctcttgtaagatcaggaagtgctcttaaccaatgagctatttatctggcccctagagagttaattttaatacagttttatcagtgtaaattttctgttatctgaattaagcatattcctccagaaaggtttgctatttgctcttaagaaatggcatcatatacggctaactttttagtttaatgtgttggggaggtggtagcattctttttggtgttttgttttgtttttgttttttttgtgttgtgttttgagacagggtttcactgtgtagtttggagaccaggctggccttgaactcacagagattcacctgcctctgccttccgaatgctgggattaaaggcatgcgccaccactgcctggcggtgtttttttgttttgttttccaagacagggtttctctgtgtatccctggatgtcctagaactcaatctgtagaccagctggcctcaaactcatagatctgcttacctctgagtctgaagtgctgggactaacggcgtgtgattgatgacacagccatagggagatgttgctttcctgtacagcaagagtatgagacatgtgtccttctcatatgtgtaccatggtagaaaaggtctagttcattctctgaccaaatgtccatgttcttcctgggcattcatccatttcctgcttcattttctgtccctgtattttcttgattattgtttgtttgcttttttaaaagaatatattttatttatactatgacagtttaaaacacccaaacatcaggtccttgattactgcataacctccacttcctcacccatccagtttcaggaccctgtacatttttcatccttggagagagaaagagaaagacagatagaagtaacctggacttctgctttcttacaagttcagtgtgcacttaaaatagtgctatggtattgcagtaaacgatgactgatgttctgtagcatgagggttttcagacaatctagatttacatgttgctggatacagcgtgacaaacatttctgtgctcatcaaactattcctttctcatctttccacagccctcccctggcctcccccaccccctgggagaaaatgtgggataaagatgtgagacgtctccagtcacacagacttcgatgggatctgaagagactgaacagtgtatcataacttttctcaataacattctgtttattctttgaggattttttattaacatttggttttgcttaattttacccacatcctttttctcagaaatgagcattatgggggttctaatggcttcttgaacatcaaatggctcctaaaagtaaccatgatggattgagtgtgaatgaagcaaacaagggtaaaattcctcttgaattacatatggatttaataattagcaagaaagctcttcataattagaaaaaactgtttaggggataatgttcaagatgcttgagaatgtgtactgtacagtcttgctggaatgccgatgccacagctagaagttaatactctcaaccaagagtgagatgcgtagtcagtttctggcacataagcaaggacagagttggggttttgttgttgcttttttaaattttgatttatttttatttaaaatatgtatatgtgtatttgtgtgtggtggtgggggtatgtacacacgagtgcaggtactcacataggcagaaggtggcactggatcccccagagctggagttacaggaaattgtgaatctcacaacatgagatcagcaacagtgtcacctacaaaaacagtgggcactcttaaccacagagccatctttcagcccagatttctctttctttttttcctctctcccccctccccgctttatgtatactggtgttttgcttgcatgtatgtaaatgtatgtctacatgccgtgcccttgtaggccagaagaggatgtctgatcctctggaattggagttacagattattgttagtctccatgtgggttttgggaactgaactcaggttctctggaaaagcatccagtactcttaactattgaaccatttcttcaaccccaggaatattttgtttttgtttttgttttttttttcccagacaggatttctctgtgtagccctggttgtcctggaactcactgtgtagaccaggctggcctcaaactcacagagattcacctacctctgcctcccaagttctggaattagaccctgagtgctgggattaaaggcatgccaccgtgatgccaggctcccttgtgttgtaagtctccattttgcaaactatttagttctgttgttttgcattgcatgtagcccaagctggcctccagcttgctatgtaactgatgacggccttcaactgctggtcctcttgtgttcatctcccatgtgttggattacgaggttgtgtcatttcaggtctttgttgttttgagaaccatatctagggcttctccattccaaggcaggcactttattatacatccccagcatcattttccaaatgtctaaacatccagagtttatttctatgaaagaaagttctttcatactttcttttgagagttgccactattgtaaagaagtcaatgtacaaagcaataaaaacaatagagtattctgggtgtaaaggacagaaagtcagtaaagatggctgtattcctcacgcattatggcactgaataagaagaaagcttcttgttcggtggagtttgatggacagacaggcagcccctgtaaagacttgaaagtgttgaagaggagagggtgccctgaggaatgggctgtacagccagagcctggggactgttgtgagctcctgggctttatcctgagatgtcagttcagcccctcagtgcttgttatatacagatatattgtaaataaccattaagtggatctgttcatgtgagtgtaggcctgagactggtggttgataatgtatacatctgtgaaatcgctaccgataccactcaatctccaggattttaccattaccttacatctttgcttatggctgtctaaggctacctcttgcacacttccgggaaaccagtacaattgtgtcttttctaaagattctattaaatggagccacacagtatgcggtttgtgtctgccttcttttgctcagcttgctgttgttgaagtttactcaggatgaaaggcttactcccttttatgctgagctttcattgggtttatataacagactatttatctccccacccactgaccggacatttgtgtgtgtctcgtccagattctggctgtgataacatgctatgaacatttgtgtgcaggcctgtgtcagcactcactgcaacatgtattgtagctaataagtctaggaagacaccacgcccatccccctagccagagtatatgtgttttggactgggagcagaggaggaagaacttgcctcagcactggaaaaacagagtctctcttcctcttgaaagaaaagcagctggtaaaaggagcagtcttgtgaggcaagaatggtgttcagaatccttttctgaagtgaggatttgtttgttctcttgggatactgaaatgctgccatgtaaacctggagctgccatgcctgtctaccctggttacatgaaggaaagttttggtggtggtgttttggttgtatgcatgccagggacagagagagagagagagagagagagagagagagagagagagagagagagagagagagagagagagagagagagagggagagggtggaatgcacgcagaacttggaatccaaagaagtcagtgagtaagagaggccccagggggaaggacatggcagagacagttcaactcttaagttctcaatgtcctagtttccacagggccagcctttccttaaacctgaggtgagacaaggtgctagcttgagatggttacagaggctcttcatctgtgaggaaagaaagacagaaaatggtttccctgacattttaaacaaatattttatttatttattatgcatacaacattctgcttccatgtatatctgcacaccagaagagggcaccagatctcataacggatggttgtgagccaccatatggtttctaggaattgaactcaggaccgctggaagagcagtcagtgctcttaacccctgaaccatctctctagccctttcctgacattttctcttctgcccatgcttagtttggcttgacagatgtgtatggacatgtgcccgttattgtgccttgcgatggaaccttaggctagggagatgccttccaacagaggaggtgaagctcgtgctgcctgggctgagggcagtggagactgagacttagaagataaagtgagaagcagatagagcacagtaggactcaagacacattcagtgttctagatggtatggagaaaggtggggacatgctggagatgccacttgcaaagcaggatcagttaggaaagtctctgaatgccaggttaagcttatgttgtagaccttgaaaacttaacaagtgttacaaagcaccagaggctaggtaggtggcttcaacaatagaaaggtttcttctcactagtgtgagaatttgatggcagatttggttgcttcagacgcctcctttgtgttctgtgtctccatgctgtcttccctctctgtttgttaatgtctgcatttcctttcttataaagacatcagtcagaatgaggtagcattcatccttctgacctctttttaacttaatttcttttaattgcccaatattgaataccgagtcattctaagatactgggggttggacatctgcatacaaattgggagcagcacaatttagcccacaacaggagcattaaatgattttaagaggggaaggacatgaacagattctactcttcttcttcctggtaaccatgtgaaggacagattgaaggaggacaagaccagacatctgaatgtttgttcaaggctttggggattgtccaggcaaggttgttacactacaaccaacatggaagatgctgtgacccgacaacatgtcgggaattcttgctacatgcttgtgtacaatcctgcagtagcagaatcagctacatgacctcatttagttgtgagacagtcaacctggagacagcacctcttgacacaggctgagggcacacttctaagtgtccccatcactcacacacttcagatgtcagttacaagtcctaggttgttttccttgtggctctgatgaatcagctacatatggaggttcccacaatcctctgcttgggtttgattgctgagtgccaggagcccacagaacttagaaggacacttaaattcaccactttattatagaggacatgacaatggatgtagattaagaaatatatgcatgaagatgtgggcagagcttccatgctgtctctaggcttgtcatcaagataccacatgttgcactatccaaaagtactcttgaccagtccttctgactttatatggagacttactgcataggcatggttgtgaatacacagaacaaggagacctagcaaggcctgtataaccacgttctccttgccctctctaaaacattcctttttcctggatacttttaggatgaggagggtctgatgacctattgtcatgcaaggtaggttagagaatttaattatgatgaattgaaggcaggaaagtgggggaaattaaagttgctgtagccctccacagggaagaaaactctagtgtctaaaacctccccagagaacggagtttataagtgaggaaccatgagcaaaaactaaaataaaaatgatgtcactgagatcttgaaagcctaatcctgatgctgcctgattagaaaataactcactcaagtgtaaactgcttctgagcagctgctgacttccaaaagatgcttctggatattctctcagagaaagggagaaagatactgtggggcagaagaggtctaggaagggttgaactgcattaccactttcccaaagccttctaggttctcagtgtagaaaataatttgttatttgttacagttctacgttcactctgatttttgtaatgcagaactatttttggtgtagcataatgaacagatcatatggagatgggcttcttgaagtgtactgggtggcaattaatagatggatggtttgggtaattttattttttgaacctcatcttccttatgtgtaactaaggattaaaatagtaacagcacttgccttccaagtgtgttggaagaataaaatgagatagagaatgagatttatattttgttgtttttgattgttttgttgtttgaaatgaaatttcttttagcccagactggcttgagtctctccatgtaggctactgatcttcctgcctcttcctcccaaatgttgggattacaagtgggtttcaccccagccagtttatgtggtgttagggattgaacccagggcttcatgtatgctaggaaagaactctactaactgacccttatccccagctaataatactaatttattgttttgttttgtttgtctgttcaaagacagggtttatctgtgtagccctggctagtctgtgtagaccagactagattatctgcttgcctctgccccctgagtgctgggattaaaggcttgcactaccactgacaggcaataaagcattttaaagagttgtatagctaatacttattgcacttggcacccttgaaaactgcatttatgtccttaggtaagaataggaggcagataatttttacagaacaaactattgagtggtgcctgcggccgctggctgtgaactctcatgtacctctttcttctggtcccagatcacagagcattgttggttcttatttgtatcaacacatgagaaaacaggactcttctctgggctgtttgaatcaaattaccaggaaaggaaaaagaaaacaatgaagcttgatttcagtaaatgctgaaatctggggagcatgtgtaatatcacacagacaaaaggaagggatcgagtagacaaaagcagaggaaaagatggagagaaagccagagtggtcatatgaaagcagaagaccagatcagaaaaacagaggctttcccgaaatgtcttatttcacatgtagtattcctgcctgattttcttaagtgcaagaaccccgggggagaagggagaagctgtcctttgtaacatcatttgagttttatgcctggttatcatcaactcattattaataatattgttgtttgcaagaagtgactctaagaagttttgacaggttcatcatcatttataatatttttgtgaatgctgtagctcacttgggtctatcagatgcaggaatacaatgcaatgacctttaaactaaaacctgaaggctgagtaaggcttagtcctggcaagaatgggcaaagaatagtccaggctgaggaacgagttcaactgtggatttcaaggcaactactttttagtaggcaacattcagtacaagagatacttctctctcaagtcctcaaagttcacactgatagctgctaagtgtcttggctcaggacagggctgaaactattgtcaacagttgggccagtgttacccaggaggccaggccctccccagccctggtatgagaacagactctggggacgtgaactgaactgtaggagccagtgtagctgaagtgtgtttagttgcccttagagatggatacttcaatgtaattgtctagatcttcttgacataccgccattgtttttcactgtgcaagttttgggggtgatttggtaacctgtcattttactgccccacccccaccccttctgtgatttctcctgctgctgccatcctcatctccaaggacattttccaggccagaagtgtcagggtcactcttccaccatttgtcaggagcaatagatctaccctggcgctgtggctttggtgattgattctctcggccactgactcccctgttctgttctctggctcaggcctcaccagctcaatctgtccctcagctcctgtcacatttcattctttgatgtccatcccaattcttccatccctaagcgccaaatgtatttctctgtaaaggaattcccataaagctggctcatcttagatctcaggaagcagcatcagcctttgttcttgttctgtcttctcctctcaccagccactcactctctcgccatcttgattctacttgtttccagtgcttaaggtgttcctcaattcactcattcatctatttaataaatatgaatcaaatgtctcttatatgttggacaatgaggctctgaagatacacagtgagaagggacccagtctctgcccttgtggagcctacatgttcacaaaatttgccagaattttaaccaaaggactatatcaaaccaatggaagacagggagatttctccaacaccagattagataaatttctaagcctgatagctggtgttcccaatcagattgttaaaccaatagacaaggtattcatcataggtctggagaaagtagtgggaaatgaggttggtgacatttagaactcttatggagtcttgaatgccaggattacaagttttgttttgtttttcattttttcctgactccaagcaacctttatttatcagaatacaaataatatatcacacaacattttccactttttgtctaaataaaagcctattagtttatgccacaggcaggcccttgtaacatccttactgactcttctaaaacgactcttcaaagtacctaagaagcaaagattccatatttttctgttcatcttgacacattcatagaattattttggcaaatatatcaggactaggaaaccaagctctatttaattgtcctaacttagatcagttatttcccagacagaaatcaggtatgactgggaaagtaagatcattttagcctaagaagacaggcaatagaagaaagggtggaactctatcacctattcctactttaggatcctactttgtttaaaactgcctggctgcacatctcaagagaacaggaacactgttgtccctgaacttgacagcagggctgtgcttcatctctctcacagctcacatctgggaatccccattggaaatctctttgtgctgcccaccttcttcccagccacatctgctgtggagggcagatgtggatgaagtcaagtttctaagcaagtggggcaggcccagaaacaacacttcaaagtacaggctgcatcctttctcctcatgccctggagtctacagacttaagctctgtcctctctggaagctggtgccggtttcctcccatccagaaaagctgtgactcttcaaagggatgtggaagttcttgctgactgacagccatctgaggagaggcggcctgtcttgaaggcaggccaaacatctgttgatgctctctgcctcctccaggataactgggctactgacagctcccgccttggtcctggggtaaatcagagagacattagaggacaaagaaggcccttaagaaggcccagcagaaagttgatatttctgtgtttctaagccttctgccatgttttccttccccagccttgctgaagtctgagtctttggaactgtggggaacagggtaattcgacttttctattaaacctcttccaaatgtgtgcaggagtcaggtatttgctctttatccttttttaaaaaattaggttgatttattttatgcatatgagagttttgcttgcctacctgtatgtatatgtatcactttgtatctggtggctttgcagtctttttttttttttttttttttttggactggtttagttatttgttgtgtatacagtgttctgcctgcatgtcagaagagggcaccaaatctcaatacagatggttgtgagccaccatgtggttgctgggaattgaactcagacctctggaaaagcagtcagtgctcttaacctctgatcatctctccagccctgcctttggcagttttaagaaggcattgtacctctggggcctggagttacagatgatagtaaaacaccatggagttgctcaaacttattctggaccctctgcaagaagtactcctaactatctctccagatccttgctgttattcttttgtttaaaaagaagaaaagagaaatattgagacagacatgagacttaagactataagtttattataaggcgcaacagaatggataaactaagaagaggaacagggtaatggctgaccgccatggccggtcgccatagagagagagagcggggaaacagagagacgggaaagcacatagagagacagggagagagagaaagagagagagagaaagaggagtaaaggggcaagagcctatcttttaaaggggtcctctgcacctgcgtacagacttctttcccatggaaccttgggctgaccagggtattgcctgagtggattccaccaggtaacaggggcaggccagcataatgcctgaacctttcattcccacctctacttattattaaaaaaaggtggggtgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacccaggcccccccgccgggcgccgcgccccggggctggggccgatcggggagagggcacccccgcccccacgcccccccgatggggaaccttcgtcccaaggtcagccacctgggcgctgagggaggaatcaagtctgttgtaccagacaccagaccttgagaatatgctgatctggaatggctctgtgcctcatttgaaccatccaatagaatccctgttcctcgcttgtgtttttttctataaaaaggcacctctcccttggctcggggcgcttggcctcacagaagctaagtcgcccgggtacccgtatctccaataaagcctcttgcggttttgcatccaagattgtggtctcgttggttcctgagtacgggggtctcctcctacgaaagtacctctttgggggtctttcactggaactggctcttgtagaccaggctggttgtgaactcacagaaaagtgtctctgaatggacatttgtttgaaagacttattcatcatggtcaaagaacagcttacattttcacaccctcatcattaaatctaaagctctaaattaaggaattatacatttgtaaatggaaggtatctttggtaaattgccaaaaatatgggctttggagtaatgttttaattgcaaataacttttcagaagtacaagaaaatccttcccgaaagcttctgtgggaaagaacatgactaatccttatgtctggagccaatctcaacgccctttgcccctacagccctgaatactccagaagcacagccagtgttgccgctgctgtctgtctacggcctccattccttttcctgcactactgacagaaactgggaaaacacttgctatacttggtctataaaactgtggctgctgctgttacccaagcttctggaaggttgggactgactttcttctctactgtgcctactatacagctcaatgtatgttttccactgaatgaaaatttcaaggtcaattattcttatttaataacagcctaaacacccgttgtgttgtgacacactcatataaccagactgaagaaaccctatttattttcagaaacaaaaaaattctcattatcaagtattgcttgggctgaaacatggctttgacttgattccctttttaactctttgactttcctgaggcaaatttattaaatcctaccaacagtattcactaatggacctcagttttgtggggttagtgcttctcatttgtgggttttgtgaatatataataattacctcttgtataaatgaatatcagatatgctccaattccacagagaaaagagctctcttgatcattgtctgaagagacaatcactgagactacgtatactgtccacagataggaacatattttaccttttgttcacagggtatcatggtctgtatggagagcccagagtccatccactgccagtagagttgtgggactcacccatctgaagggaaaaggcaaagtctagggttttataaaataacatagttaatgtttaatactaactgcattagtagccatggattttcattagtttgtgtcaaagttaattgaattataaataataaattttaatattttattaacttaaaagtaaaaacaaagtgccaccttataaagttggagacctactcttggtgggagggagaaccacacatagagttatattatggccagcagactcatgacatgtattgcgtgcactcaaagatgatccataatgctaagatttctttttttgttttttcagcaaaataaaattccggtttattgttggacattgtttcacacatacatcaaacaggacaaaaaaataaaacagcaacttcataaaaaaaaaaggaagaaaaaaaagaaaccctttatctttggcctttttaaccatctcatacaaaccaactacttatagtacagctaggtacatatacaaaaaaagttactggaatgctcggaataagattggtttttgttgtttttgtttttttacaagtttttttttctcctttgagattataatgaacatggtcacaccacaaataaggtcagaagtaggacagaaaacgctctgaaggctggtttggtcacccgttatcattaaaaatggctgaccctctaacaatatgtacaaaaatataaaatgtaaataaaaaatacaaacaaattttccttttaaagtatttttaagaaaaaaagcagggccttggaagttttggttctttttccctcccctgttgcaaattcatggtgtggttttggtggggtggtggagagcgcatgtcatctgtgggtggcactgcccgctaagggcggggcctgctcctctactcgaaggtgaccacgtttaaattctgagaccggaagtggagggtgactaggtcacggtggccttaagtttagcttttcctttctgctgtctagtcatcctcatcggccttctgcttcttggtgtcaacatcctcatcatcttcagctacccgcttgcccgtaggagcctcagcttcctcatcttcatctccatcctcttcctcactgtcaccttcctcctcctcctcctccccaccttctttctcttcttcatctacctcattgtcagcctcctgctccgcattttcctcattagcattcccattggcaggcgcgtctcttccattctctgcctcctccacaacttccttcttctccttcaagtcctggaggactctggcgagagagctgccagagtctgccccggaggaggggggggagggggctgcagcgcagccagtggagcatgctaaaatttctttattcagataaacaaagccctgacacagtagtagctcgaggctactaggaggccgggctacagtgtctccctacagacaagttaaaggttatcgtgagcatacccagttttacctcataaaagtgttgaagatgtgtgtccttttgaaaaatgtgtgtgtgtgtgtgtgtgtgcacgtgagcgctcgcaacttgtttatacatgatcagctttctgaattaagattttttttcccaaaaatagggtttctctgtgtaacagtcctggaagttacattgtagagcaggctggccttgaactctcagaaatccacctacctctgcctcccaagtgcctcccaagtgctgagattaaaggcgtgctccaccgccccaccacccccgcctgaattaagattttctggttctttttttttaaatatatatattttatttttattttgtgtgcattggtgttttgcctgcatgtatgtctatgtgaagttgtcagatcttagagttacagatagttgagctgccatgtgggtgctgggaattgaacctcggtcttctggaagagcagttagtgctcttaaccactgtaccatgtttccagccctaaggggttttttttggttttgtttttgttttttattacatatacagtattctgcctgcatgtatgcctgcatgccagaagagggcaccagatctcatcacagatggctgtggtcaccacgtggttgctgggagttgagctcttcttctggaagagcagctaatggtgctcttaactgctgagccatttctccagccccttcagatttaaaaacttcagatttccatctgtcctgatggttctggagagatgggtcatcagagaaaggtaattgtagctaactctgatgagtgcgatcccagtgtctcacatggtggaagcagagaactgactcgcacaagttgtcctcagacttccacacatgtgcacatacatataaataaaagtaatgaaaattattttaaagtgaaggaaccagcttcccttttggcagccataacagccgaacacgtgcttgccataaacctgccttggtcacttagaggtcagatgcctgtctcgtgacaaggaacccatcagaagttagtcactagaaagtcagatgcctgtctcgtgacaaggaaccaatcggaagttagctggtggcgctatgctttacgaccctgggtgtgctttaaggacaagcgcacagcaatgaggtagagagcatagcaaccaccctgggagggcctatgggccataacaaccagttgaccaatcaacacagggcaagccctccaagcctggaagcacaccaatcgtgagcctgtgcgtaagcctgtgcgtacccctagacactccccttacgctgccctataagatcttccgggagcccctaggagccctctttgctagccatccaccatggtgggtggatcaaagacccaagctaacgtggggttagctcgttaaactacaataaagcctcatgcaatttgcatcaagctttcgcctccattctgtgattggggtggccgaggtcctgggctaagattctggaagcctcagctttctgagggtcttacaaaagtacatatttttacccctaaatgagaatcctaggtcaaaaaaatatgaaaattcaggttgcctgaggaatgaaaataataaagttttattggaaatcatttgaaaaatctggtgtatttacagcttgttcaatatagctcaaaggcagacttggaaaatgttaattgaaatattttcctagcttgtagagcatattcttgcatattctttaaggggtaatttggttgaaacagatctcattgtcttgctttagccgttcttgagtcagttttgtttttccctggagttcttttgtttccaaatctttcacaaatcaattggggtcaattatcttctatgcaataattcagatagtttgcatgcagctggttctccttaatcttaagcatttttcagagtcgttttgcctcctaaccaaagttctctacttctgtgaactatataggattcttgacagaattttacagggtatacagggttcttgagtctgaagtgtttaaggacagctgctttgctgggcattgatggcacatgcctttaatacagcactctgagaggcagaggcaggcagatctctgtgagttcaagaccaacctggtctacagagcaagtgccaggataggctccaaaactacacagagaaaccctggctcgaaaaaaaaaaaaaaaaaagaaagaaagaaaaaaagaaagaaagaacagctgctttacattgtttagaggtaggaagctggtctcctatctctttgtgctctattatcatacatatacaattctaataaacatgaattgcttattgtttatacagatgtgggaagtgagccacaaatgtcaataaacgaaaggcacgcactcatgtgtgtatgtgcgtgtgtggtgtgtgtggtgtgcttttacatgtgtgtgaaggtgtgtgcctgtaaatgctcatgtgaagccagaagtcaatattgcatagctttctcttcactttccaccttattttttgataccagttctcttactgaacttggagcttgccatattgactacactggctggccagtgagccctcaggaatccatctgcctccacctttccccaagctaggttattatagatgttggcttccacacctggttcaagacctgcttgggctttgtgagactttttcttgaaaaaaaaagacaggtgctagagagatgtctcagagggttaagaatactgaccactcttccagaaagcccagcttgatgcccagcacctaatcagcagctacagggatctgagcccttctggcatcctcaggcaccaggtacacaagaggtgtacagacattcatgcaggcaaaacacccatatacataaaataaaaatagaatataaaccgaagaaaggttgaaatttgtgctttagaggatatataaaatgtcaagacagaccacagaatgagaacaaatagttacaaattttgtatcttctaaaggtctagtatttagaatacccagattagcataaaggcaaatatcccaatttgaacagatgcaaaaattctccacatcatacccacaataaaatccagtgttatactcattaggactaaaataatctttaaaggactgtagcaagtattgacaaagatgtggagaagtaggagccattataagtgaaggaaacactggcaaaagaaaggaaaaagtagctaaacagaaagtcatggttggaggtgtctgcaccttcctcttggaaatggaaagattggagagtcacagaatcagccagaaagttgtaaatagcaatgtaaaacgaatggacctgactgcatttattgagttctccaccccagactgaaaaatgcacattgttgcctaatatatctggattattcattaatatgtttgaccataaaaaactcaatatatttaaaatattggaataatacagtgtaccatttcatagcctaaaaattgttctaatgtctttactgtaatataagttaattaaataatgaaaattatctgactctccaaatattttgaaattaaacaaatgtgctagtttagggctaaaaatgatctataaccttgagtttttagcattcccctaaacctaaacatactcgtgaacctatcagagaactttgtttactgagaaaagaaaatctttaacttttaaccttataacagattacagagtttggctacactaaataaaaggggccatttcctggcaacctctagagatataacttgagagcctccaacttaattgtaactctcccttgaggaagaagcccacacctgtcctattggatctaatatattcaccttcatttcagatttggctcgccttgaaacccatttcttcgatgaaactgtgaattgcagttttgcttgggtggaagtctctaaaagaactcggggagctgccagtgtggtacagagatgtgttcctgtgactggtgacagtttgacagtctccctccagcatcagagaggcagcacaccatggggctctgtagaccacccagtgcacagccaggcgtcatcgtaagaatggggccaatggtttgagactgagctactctgaggatctgaaaccaaagaataatcacaagtcagggcggatggggacacttgcccacagtgtctgggtggaagacagccacaagaagcagttgttgtgttggggggtgtgctgtatgcagaccactgagaggtttgggcagcaaggggctcaggctgtagacaacatggtggtcagtgaccccgacctttgtggtgaggaatagtcccataaactgtggattacagtggaaaatgacagctctaagatcatagcagggataactcaattccacatctgtttcccttctataatgtggtttactgtggggctggagctgagagagctaagactaccacgcagagcacttggcttcatgagttctgcactgcagaattcagtgcttttatcccaccatctgatacataataggaacaccctttggcctagatttttgctgctcctttatacataaactaaaggattctggagtaaacaggaatattcctgactataaagctcattggggacagcagcaatgaccagtaaacaaataaaatataggtgctggagagatggtcaatagttaagagcaatgaatactctttcagaggacccaagttcaatttccagtacccatatggcagcctacaactttccagggggtctgacaccctcacactggcatacattcagacaaaataccaatgagagaaataaaaataaataaatctaaatgaaatcagtccagatgcttgactgatccagtccctgacccacatatggtactaacttctacaatggaaatacaaaggaagatcagaagttcaaggttgtctttttttgtttgttttttttgagacagggtttctccgtgtagctttggaggctgtcctggaactcacactgtagaccaggctggccttgaactcacacagatccatctgcctctgcctcccgagtgctgggactaaaggtgtgtgccaccctaggttcaattcccaacaccagcatgatggcctacaaccatgtgaagactccagttcctaaagatccaatagagtctgccagcctctcttagaaattgtgtgtgtgtgtgtgtgaatgaaacaagcttcattacaaaagatagcttaaaataagagaggaaggggtgtgctggctagttttatgtctacttgacacaagacaaagtcatttaggaagaggaactctcagttgggaaagtaagattggtctgtaggcaagactgtaatgttttcttaattagtaattcatgtaggagggcctagcccattatggttggtcctgggtactataagaaggcaactacaaggaacaaggtagtaagcagcacccctctgagacctctgcttcagttcctgtcttcaagctcctgccctgacttccctcaatgagggactgtgatgtggaactgcaatctgaagtaattcctttccaccttatgctgcttttggtcattgtgctgtatcacaggaaaaagagaccctagctaagacaagaggacaggcctgtgacctaacaacccccccccacacacacacagtgaaagcttcccaaagaagcaaaagatgtgtggaagtttgaatggaattggccctcataatctcataggaagtggcactattagaaggtgtggttttgttggaatgggtgtggccttgttggaggaagggctttgagggggcaggctttgaggtttcatatactcaggaaactgcctagtgtcaacttcctgttgcctacaagatgtagcagtcttagctccagcactgcctctttctgcatgccactatgctaattgactgaatctctgaaactgtaagcaacccacctcaattaaatgttttctttgtaagagttgccatggtcatggtgtctcttcacagcaatagagaccctaactaagacaagatgtcagaagtcaggttagtggcagtccttgggacaacaagaacctagaagtagggaaaagagggcctatcagtactggtaatttccattttctgtttctaggcctaggctttgtttttctggttggttcacagtgaaaattcatcaagctgaacactttttctgtgtgttttctcaattaaaaagaaatgttacttacaagaaaatacaagctgggcatggtagcacacacctttaagttagctgtcccatcctgtaaggtctgaatccgtttgtccttcctcaactgaggcagagtctttctgctcttttcttaactacaagagagtccctgctggtagaagaggctagtctgttttgccagcagatgtggagtcaatgatggaagcctgggcaggccatgttatccttaaaagtaatgagacatggagaacagtaacctttgatacaggaaatttaggggtatctttgagtacattagagactttctcagttcttagtgagcttagcctggaggtctagggtccctgaaaactcaacagccattcaagccaccctgagctagtagcttttgagtttttgtccagagaatttgaagaatgagattcataaactgtagcgtatacattttagagaagagtttcttatagattacaaggagggaggaaaggagagggagagagagagagagaacccatgtagcaagagtactaagtggaggcttttctgtcccaccccgtcctgcagctgcttttaaaataatcactcagaggcttaatattaattacaaactgtttggcctattgctcaggcttgttgctaactagcttttaaaacttaaattaacccatttctattaatatatatcatgcatctatatataataggcaatacttgttctctagtatatcttggtgctcaggcagctgctggcatctccctgaccctgcccttctccctgtatctctgctttgatttcttgcctggctgtatatcctgctttgctataggccaaagtagcttctttattaagcaatggtaataaaccatattcatatcatacagaggggtcccagaaatagagtatcactaagcttctagtccaggtttgtttttttgttttttacttttctcttttcttttttttttaagtcttaagagtaaaacatagggagggggataagctggtaggcccagttggtctagtcagatgtccagttgcctgctctcagttttggtcacatcctcatgtattatagctcccaggcaaggacaagagataacaacggactaggaactggaactgtcttttgatattccaggtctccagcagggacatttgtagagctgattcgttggggtctgtattagttacttttttgttgctgttgttgtgcagtaaaacactctaataaaagcatcctaaagaagaaagcttatttaggcttgatgtccacaatggtagggaagccatgctggtaggagcaggatgctaagaaatcacatcaacagcacacaggaagcaaagaaagcaagaacaggaagtgggtcaagacaataaacccttaaagcctacctccaatgacctatttccttcaacaaggttccaccttctaaaggttacataatttccccaaacagtggcagcaactgagagaccaagtgtgattccaactatgactgggtcctttccctaagtgactggtttctaactcctatttccccgacctaggatccaaggcttaaaaaagtcatagggttgagcaaagtcttgcccaggtccctaattatagtaatgccaagggtggagagagcattttaatgtatttaatatttgaattggcttgacatagataccaagccagttgtcattgcagatgctgctctagaaacaaatggcaagaagagctgctataggacataaggaaacaattttaaataacgatttttccccctctgaaagcccgcctactgactgttgttttgaatgagtcctgacggccctggagagcagaataagcatgggaatcagtctacagaactatttcagaataagggagaagccacacccttcaccctctcacaccctcagcaagatccaaatgattaattagaacatttcatatttaggactttccccccaaactgacacttcctaaaaatacccataaaggagaggaataaattctataagaacaactttgtgtgtggggggcaggtgaagattgagcagctggatccccagcaggcaatttcaaagccctgacacagaatgagtgtcaccacactgtaaagaatagcagcctattaaaaccaattgtctccatttggctgcctgttttcttatttctgactctgcaagggctctaaaacaataatgtcccatgtttgggttcctgaacacacaaaattctgctttggaaagcctcaacctgaaagaagctgaaaccaaatacttccacctgcaatttacttccgagttaagagtcagtctcttttcttcatctgcctgaccggatattggaggaaccaaatcaaagggctataatgatccccatttccacctaattgcctttgcatgggctgtcctgctacagactgtgtccaaagcaaagccaccagcgctactgccctcatgatggagtccccatgtcttcagaggatgacacacagacactctgtaccttcagtgtggggctcactctttccccttatttcacagagcagttggaggctggttggatttctgatgtcaggcttccaggtgtgggtggctcccttcccgcctgggtttgctcttctgatggtccgtgttgttggctttgcaacatggctgatccctccataagggaccttctcctttccccatgtatctcagtagggctctgcattctgccacggggtagggttcaatccttcatccttctattttctggtgctgttttggctacctgcctgcaagatgtgctccatggccagctgtctttacaatgatttaagtgcttacatattttgggaacatttgtgcccaaataacacccagaaagtgtgattctggaattctaataaacagaatgcaccagggcaaaccatctaaaaccaaaactgggggaaagttttctacaggagaagcaaagaggcaaaactaaattaagatgacaaaaaagagggagaataaacctgaagaagtaagcaactcatgcattgcttcatcatatctattccacagcataaaactgttgagacgagactgtggaagaagtttcttctcttcccactgggtggggctcaactatcattatacaggacccggtcctttccttttaggtgcttttgtattcagtaacagataattccagatgtaaagaaaggatccaaaatcaagatgtagggtttttttgtttttgttttgttttgagacagggtttctctgtggctttggaggctgtccttgtagaccaggcttgtcttatagaccaggctggtctggaactcacagagatccacctgcttctgcctcccaagtgctgggattaaaggcctgtgccacttacacttgctttcttgttgttcttggtttggttttattgttgtttttttgaaatatggtctcatgtaaacctagactgctctttaaattgctgtgtttggtgaggatgatcttgaattcccaatgatgcacttgcttccatctcccaagtgctcagtttacagacaagtgttccagcttaaaaaaaaaaatgttgaagagttatgaatagtcagaagggattggacaaacacctcaacagtctctgtttccctgtgtgtttagctggtaaacaggcaagactctggctttgctcacagtctaaggactaaaattttgaaactcaccaattcatatgagaaaattgaaaatcccagatggttaggactgaaagtgagctcccttcttggctgagcttcctgctcccagtgtcactgattcctggtcctgcctcaacttatagtcagaagcaaccactggcaagaagcccctgtcagtgcagccacagctaagctgcctttcctcaggtttctcttccagggagggggagctcaggtgtgggctgaagggcagccaagtgagctgcagcctaggaagatctggttttcctcatcctagccccacagcaagttaaccccaggagagctgcgatggctgcagaagagttttgttagctgtctaatgcctgaatgttacctgccgggacggtaaagctgccaggcactgatatgctcagatgcaatgagatcctcaactgtttaagatagtttgagccgcaatcgtttcctagaacaatttcaaaacaggtggaggccctaccactgcaagtaagctcttggaaagttgtatattagagtgcactagcagacatcatttacctgtttaataaagttgtatattagattgcactagcagacatcatttacctgtttaataatgttgcttatgcaaacaaagcactatttggcccagatgtttttacccagaagagaaggaagcaatgctctccacatatcctttgatgagatgaaaaacaactttgttatgataaatctttccgccaaaagccgcccaagttctactgccacgtgggtggtctccaccagccaccggagttcccagcgtggatggacaaaataatacacagacttctattaggtacaaatgttgcctggccaatgactaggattctcatctgttagctcagtcttaattatcataaatctatatattttataagacttatcggacaccttccattggcctccttgctggtggatcacattgcactgctggaggaggcaaaggggaaaaggagatacttcctgtttctccttgcttaaatatgagtctccttgctatgtcacctcctgcctggatcaccacttctcaactacatttcccagaatcctctttgactcctagtcctgcctaacttgctgtctcattggccaaccagtattttattcaataatcaataagataaacatacacagtagtacattccccatcacaacttgtttgctctctgaattgaacaaaagaggaggaggaggaggagaagaaaaaaatacaaaatcaaactcaacatctggatggaatttagtatgtaccttctgggatccccggctcctgaatgtttcggctaaagactccctcttccgaggctgcagaggctcaagcctggtgggaaatggtactttgatgccagttcctgcaagttggtttaaataggttgtcgggatgctgtagccccaaccaaaccctgctgagggggaggggagcaaatgccttgcaggcatgcttacttgtgtctgggtggacacctagcaaggaggtgatttgtcacttgtgtctccagacctggaagtgctcttgtatgttgtatggtaacaaaggaagattctagctgggaagaggaaaatcccacaattataatatgagcccgagggaggagtgccatgatttccttgtccccctctcttgcagccaatctcactgaaagaaagtcagcattgtaaccctagttatagtgaaagcattaatcccgtttaagtttgtctcacttcacatatcagagcaatgatcacattcaaacacacacaaatagtattagtgtcatgctttgaaatggtaaggtctacccagctacatgctgggaaaggaaggaaggtattacatctataaagcataaaagtgtacgttatttttagccttgtcaaaaacagtcctgccaacctagccaccttctggaaattgctgtctagtttagttattacaatgctttactttaaactgagttatctgtatggtattacaatacaataccttcaactgcgttatctgtaaagaaaaaggtgtattttagcttatgggactggaaaagtgaaagtatgaagaaagcttcagtgagggtgttgtgccagaaaacttctaggagaagtgagcctgtgtgcaggagcatggtgaaatgggacagtaccagtctcatcttatgatagagaggtcgctcaaccctgtagttccagctatttaggaagctgtggcagggcttgtaacttgagtgggatgatttcactattctcatgagaactacagtaatgccttcttgcaggagaatccaacactattatgttacactattaggaaatcacaacatgaaatttgatgcaggcaaactgtattcggatcatagcaggagtttatctagaatttgttcctgttgcagcagctgataagaatgaactatagctgggtggtggtggcacacgcctttaatccagcactcggcagagcctggcaggtctctgaatttgaggctagcctggtctataaagtaaagcccaggacagccagggttgttatacagagaaatcccatctcagaaaaacaaaacaaacaaacaaaaaaccatgatattgtaggattaaacttattctaaaaaccagcccttgggtttagtgggtagttcttaaagctgagatataacattgggagataaataaagattggctccagcttttctaaattgcctgcaagagttgaagcttctagaactaggcccatgtttttgttgaacagaattaaagaacctgtttggaaccaaaggacatcaggagtttgccccctttctgatcatattatatagcagagcaagtcagtggaggtaggaagcacacaggtcttgtcttgatcttgggatattatggtaactccaatcttgcaactttggggagacttgagacaaagtcccacatacaagtcacatactctagcgggaataccctaattggctttcttttgcaaggataaacatcatgactggaagcaacttggggagaaaagggtttatttcatcttacagcttacagtccatcatgaaggaagtcagggtaggaactcaaaggcaggaaccaggaggcaggaactggagcagaagccatggaggagtgctgcttactggcttgttcccatgacttgcttaatttgctttcttataaaactcagggtagcactgtccagcagagtgagttggatcctgtcacaaatatgattgatcaagaaaatgccttataggcttacctacaggccaatctgatggaggaatttcctccattgctgttccttcttctaaagtaaccctagcttgtagtaagttgactattcagcacaaggaatagtctcttaattagatactttattttccttcttaaaacatgtatgagaaagtgaaggaaccctgtgtttgttgttttctctttttctttttgacccaaaacatttcgtacttcccctgtgtccttgtttgatttctgctgctactctaataaaatatcctgagggtcatagttactgttctattgctgtgaagggacaccatgaccaaggcaactctgataaaataaaacttttaattgtaggattgcttacaattttaggattagattgttatctctgagatgctgagaccccggcctttctgagagttactcttgtgtcactatgacagaataccagacataaattaaagggaagaattctttactttgactcatggtttcaaaggattccgtttgaagtacttatctccactgttctgacctcatggaaacagaacatttatgagccacaggattatgcagtaactattcagccatcattttataaggtcaacccatcagaatgaaagattctgttggaggattaaaccaagatgtaagctgtgttggagttaattgccttttgaatgaactggctttcttgctgtagtttgtttccatctgttacaaattttggatttatttccacagtttattactatttgatcatttattgggcacattttcccctatgcatttgaggtatattgataacaccccctagttatgtgtgaaaacagtcacacagtcaaaaaaaacctgcttcccacaaccaggtctttgttcctttctccaatgtaaacgcagagatctgccttcctgcaaatatcttcattggcaggcgtttggtcagtgctaagtgtccaggcaaagtatttcaaggacatagaattactacatgcctaaaagtattgattcatagtcacttagatagaaataagcatgccttggttttacctcgattgcaggtaagagaagtgatagcctaaactaacctcacactaactccttgcacttaccttcatctcgatttattaacccaagattttagcttggagatttattgcttgtgttaaccctgagaaaatagtgagtttgctcatcttcagaggagaagtaaactatctacagacctgctgaacatctgcacctccacagtcagagtggctgggaggtgccaggttccgtttcttgtgcaagttaagcttaaatcctctctttgttctataaccttaagcaatagatttttagccacacttaaagaatgtagataagcacacaatttctcccatttagactcccttgttgacttaatccctggaggagccttcattaatcactcttacccggtgccataaatgatagctgacagttattctctgtgtgtgactcttatctgccttggtgaccctgagaaactcaagcctcacattgcattgccagaagaattactgttgtaagtgtatttataccagtaccctcactgtagaagattttttttttttgtagaacaatgaagagatggatagacagaacatgttgtgagcagattcttgtccttagccctcagatcttagttccttcacttattgtaatgtctcctttggaccctgaaagggtttttaaggctggcccttataagccaccaatagaacagcatggtagcagaagcgcagaaagtcagggaaagaaggtgctggcagcaggcacaattatcaaaggacccagtgactcccttcttccaactaggccccactaacttaaacactggaacttccaaagtaataccactgggctagggaccaaacattcaactcgtgaacctgtgtgggactttcctgcttaaagctgacattttcaaaaccaaacacagtattcattcacctcataggagtcaagagagagtttatcagaaacagaatatgagtgactatggcctgggaacacaggtttatatcaccccaccccacccccaaacacatatgttacaataaggtaacaatttcatgaaggttttatagtaacaaaacagagaaagttataaatgaagacagtttttaaagacattggtgggaacagcaggcaggtgtgttacagcagagcaccatctcctgcgctgtcagcctcagatggtgtctgaggacattcttagcttttgagttggtggactctgagcacctgtttgtacagttcaaaaggatttacccaatagtgacacagatgttaggtcacacacagaggtgggcaatacacagctaagatgtttggctctggactcgggacattccagtcactccacaatcacagaagttctagtcagccaatcagctgttgttgtagaatgttcaatgtaaatgtgactccaggaacttaggttcatagttcccttgtcattcaagcattatgttttgtgcatgtgggggctagatattatttcatgtctcaacattgctaggatggctcattggtcggatctgataaagatgaggcagagtgggcaggaaatcagtctttagaacaaaaacatcgcctggtcttctgtttgagcacgaggacatggatctgttcccacaaacgctaccttttgcttggagccagtgtagcagatggatgggtgtaggtgggtgaggcagaaaggcctctgtagacctggcgtactgtgccttactccaaccaatgtgcctaaagactatctttgcttccttgtcagtaaagacgggaactcgctagttctaacataagcactggcatttaaagtccccaggcagagaggctcaatggataaaagtgctttctatgcctgagttttattctacacagtagaaaagcaagtaagggactgattgcatattatttctggggtttgtcagtttattaaataagaaaggcattgtgtgtggcaggggtggggcggcatctgaccaggaagacgtaggggagcgtgatgtttcagagaacagtcagtctcatcctttcagcctttattgtttgaaccttccactagtcggggcctcaggagagtccagctggcccaagggtgtaataggaatctaaggacagggaacccgtggggtaggaggcctgcactgttcgtaaatacaggcatgccaggatcttcactccaaagagtgtgtcccctggctggccctcctttcttatatttttcaggctctgtgatctttactgtaaagcaaaccatatggtttcgatatgggctcctggcttactgaaagcttttcatgtctccagcaccaggatgctctttagcccctttaaacaaccacttgggcatctaagatctctcaccagctgggtgtaagagcccactggacagcactatgtggggtacagaaaggggggtaagaaattatccatgtggggagatacatctgggattcacagaggtgagcacctggctcagtcacctgcgagtgtcaaaatagggggcaggctttttccctctccatgctccagctagatgtccatctgattcctagtgtgacatggccctttcctgaagagagcagagcccagaccttcttgaagaaattagggaaggaggtattatcttaataaaggaccatacaaagatccaaccccataaattggctctccagtcaccaagatcagattaagggatcaggtacttgttggacgaccaatgagattcattcaaagaaaactgtgattggagcagtgagaaggtgaaggatcagccatttcccagaaggggtcaaagctactaagggcaccacgaagggatgatggaaagataaggaaaacacccaagcaatctctatgtagttgcaggtttccattgtcagtcagttgttcttattcagggccagtgtccctgttcacccctctgcaaggaagcctttcttagcatattcccatatagctggacccttgcctccaagattccgtccttctctgtatcatgcaatctcccttccttcctagaactcgtagttgttgaaattaccttgtttagttgttttggtctcatgctctaaccatagtgtaagtgctaggaaagtgtcccatcaatgctgccggctcagggtctaaaatgtcacccacggctcagggtctaaaatgtcacccacggagcagcaggttgaggaacatgctcaacagggaggggtgtgagcagagggtgaggagggagagctgacactagaaagccagatgaaactgggatgggattcatatggccagaaggactataaatgataaggagaacaaccacattttgcctgatgtcttccagttttgatcatagccaacagggctgaacactgaacttccggtgtgcccagtgttatgctaagaactacagctaaaaagacagatgaagtcacaggcttagataatgaggcaaaagtaaactggagactagctctttcctgagtttttaatccctacactgaattgatcatctaatggggaggagacacatataaaaagctcagctacatgaaataggaaaggaaacatgagagatgtcaacgagcttcaaggggaacatattgagggaactataagagaaagtttttgtttgtttgggggtttttgaatccaggctggccttgaacttgccatacagctggctttgatcatccttcctctatttcctaagtactggaattgcaggtgtgtaccactatgcttggctggatgaaatttcattttggatgcaaagatgagtgacgagttcattgggcagagacaggaagtgtatttcagatgaagtgaccacatgagaaggggcatggaaacctcagaatacttgctacatccagagaacaacaagcagccattccagaaaagaaagaaaaaaaaagaaaagaaatcagcaggacttttgtttctaaaaatcatcccagggtgttagaactggaaactgtttttgactaagggaaagaagggctcttaaggttaaaggaatgcagtgaagaaagaatttcccgtgctgggctatgagatggtgctggagaaaggtgtgtccttgtgaggctaagtcccagggcagcagccctttcacagacctctggggtcacatggcattgaatggggtgcctgtgtactcggaaaggccagtgaaggcattgctgttgggagcctccaccccaggcctcatggctcagacagacctagagaagagtcttggtgtaaccactgggaatggagcactaaggacagcaggcactgactcagactgtctccctaaataattaaaagcttctgaaagggggccaagatttttttctatccattgttcatgaagagccaagagcagttagaaaactaagaaaatggggcatttgttgacggtgtttaacaccagccttcactcttacctttaaatcagtgtgtgctggcccaaagatgcctccagccttattcaagtctgcctcttaaattggagccttgacacattccagggtgtgtgcatatggatgtgcagtcttccgtgtgagtaagcctcacccaggcctcagattccagttcctccggcaacaacccagtgaggactgagacaagggtgaactcagaccatgagctcacttgaagagaaagggaaagaaactggcagaactgacatagaatcggggtccccacactctgctgtgaaacttatccacaagactgcactgcccccaggtggccacagcactcttcatgcctgacttactgtgccagtcttccaggtggatctcttcccagactcaggggagggaagaaaagagccaaaaccttgtatattcctttctgggcctgtgctgtgttatccactgtttgtctccctcccaccgcactctctatctatctaccttcttcccttcctccctaggagtcagttttctcctttcaccatgtggtgaaaggttgtcagccttagcagcaagcacctccactaattaaaccatctcactacctgttaacagttttcctatccatcttcttaggtgtgtgtgtgttatacacatgatatgcaggtgtgtcttcacatgagtatgggtgtgtatggagtctagagctaagttttgggtaccttcctctattactacccaccatattttttgaggcatagtctctcattgaacctggagttgtcatttatgccaaacaagctcccagaatttgcctgtctcctgcccatcctacagtgctgtggttatagacattcatgggctgctgcacttgacttgatatgtaggtgctggaaatacaaactcaggtccttatgctgccccagcaagcacttagccctctgagcaagagtgggagtgtgtgtatacactcttggttaagagcatggctggcctatgtctacgggttaggaagactgttggagggggctggagagatgactcatcacttaagggtactggctgctctttcagaggaccccagttcaattccaagcacccacatggcagtttacaactgtctgtaactccaattccaggggctcttataccctcacagacatacatgcatgcaaaactccagtgcacattaaataaataaataagaaaaagaaggaaggaagaaggaagaagaagaagaagaagaagaagaagaagaagaagaagaagaagaagaagaagaagaagaagaagaagaagaagaggtttgttggagtagtgacagtgctgacaggagctctccaggggcctcatctcctgttctgcctgactttacacgccctgaagacagcagctcagtatcccccacttaggacactttcagacacaaaaatgatacagcaagagtccctgctcccccctcagttctggggtctagtgggagacactggccaccctggccttatgaacatctgtgggacatggcaggacggagagatgggtgcttctaggtgactgccattcatgcggtagagtcctcactttctctaaattcctgggctcatctaatctgcaatttttcagtctcactgtactttatcgtactctgcttattcacacgctttctgggattcctcatgcgagttctccaggctttgccccacacttagaggaaacaggtagatgaccatgaagcagaggttatgagtgccagagggagaaggtgatgtgggaaaatcttggctctggtcctcattgatcgaatgaccaaatgtaagttattggtttttaaaaaacacacataaaacaaacaaaaaaccccaccttttctgaggggctgaggagatggctcagttggtaagattcttgccaagcaagggggacatgagtgactgtgatccacagtacccacatcagacaggcagtgcctggaatcccagtactgaggagcagagacagggtcatgcctggggctctgtggccagccagaaaaaaaaaggggggggtgacaagtgttaaaggaagtcacccagtgtggatctctaacctacatagacatatgcagattacccagagcaaagctccctgagtttccattttctcatctggaaaatgtcccatagggttgttataggagaacatactcagaaagttcaaataagtggcaggtttcatagcatcattgttataataggttcatcctctacaattgcttgtcctacttatcttttaaaaaaatgtcccaccattaaaagattcttattaggttcaatattcaaaagccctgtccactgtaatctctttagggagaaatattattcctatccattattactcactgtcatgatcctgaatcagttcaggtcaaacaggacaggaattggtcacaagcactaatattgtgtgggcaggaatgaggaaaagaaatgtttactaaacctggtataaggacttcagtcatatctccatcatcatcgtcgtcattgtcatcatcatcaccatcaatttggtttgtgtggatgtgaatgtggacatgatcagagaacaactttgggagttggttctcatttaccaccgtagtgtctctttgtgtttcacactccaggctagttcgttcaagaggttctggctgattacagatgtgtgccaccacatctggctttctgttgttgcatttgtttgtgtgtagaagtggtggtgtatgtgttctcgagggggctatggtgcacacgcagaggtcagagagcagtttatgggagttgtttctctccttccaccatgtggttctggggatggagctcaggttgtcaggcttgagcaagcacctttactcactgagacatcttgctgacccctcccctccaaatccaactttctgagtgggttctggggtcaaattcaggttgccaggcttatgtggcatgcccatttacctgctgagctgtctccccagtcccatattactaatttttaataatatattattgtttttgctgtgctaagggttgaacttagggtctcattcatgctagtcaagcactccaccactgggatatgtccctgcctcacctaatacatattattgtttactggatattttaaaaacttaaggacattcaagtacaaagggaaatgtacgttatctatctgtgtcattttttcataatcagaacataattccagagggaaaaaaacagttgttaaattctaaataattactgataccggaagtaaacattttctgatttaaaatgaagtaaatgttggcatctggtaatagtgcatcaaacctgaaagtgatgttttctagatgtaatccaagctggagagcaaactggagaggcaccttgctttctcatgaggatataattatttggaacaccttctgtatctttttattttttaattttatgtgcattagtgttttgccatgggtgttgggtcccctgaaactggagttacagacagttgtgaactgccatgtgggtgctgggaattgcacctggatcctctagaagagcaatcaagtggccataactgctgaaccatctctccagcccccaccttctgtatcttatacatctcatacatgacctgcacttttgcaaacaaaagatgggtgtattagaataaatcaggccagggagctgggcatagtggcacacacctttaatactagcacttggtaggcagaggcaggtagatctctgtgagtttgaggtcagcctagattactagtgagtttcaggacaaccagagatacatagtgagacctttgaaaaaacaagacaaaaaacaaaagaaagaaaaatgaggtctgaggaatgggcctgaggcttggaggctatcctcacctgtttagcaatctagtataagacttgcatttttgcagtacctttgatgaacaggctagattggcacatacaacacgtgttcaataaatagctggagactggcttcatgaattaactagcattagactaactcaatccaattcttggtctctgggaagccaagaagaagatacattttctgaatatgctctctcaactaccgtctacaccagtaacagactcagcctaaagtctaagcaggttaccaacatgccacaggccagcatatcagaatgggttctatgcgccaaaccatacaaataacagttctttctcctctttcaaacttgggtatatgactttcataactgcatttagttttggaatggtgttaccccactaagcaataagataatttccaagtaacctttcctctttaaaaatgtgttttatcattacatttgtttatttatgtatgtgtcgggggcatatattcagaagataacttgtgggagttggttctgtcctcccttatatgggctcagaaaccaaactcaggtcatcagcttgtggcaaatgcctgatcttgctgagccatgtcagcaaatctataacttgccctcttttttttttaaaaaaataacctctttttttttctttttaagattttatttatttattatatatacaacattctgcttccatgtatatctgcacaccagaagagggcaccagatcttataacagatggttgtaagccaccatgtggttgctgggaattgaactcaggacctctggaagagcagtcagtgctcttaacctctgagacatctctccagccccctataacttgccctcttaagcgtcatttagagaaagtggagtgctctatgagtgtgtcttacactgaaataaaccacactactgatccagtcctcatggttgcttgccaagcacctcatccactgagtcatctcaccagtccctttatttattttgtgggatggagggtggggcatgccttgctacagtctgcatgtagaggtcagaaggcaacttgtgggaaatgggtctcatcttctatcttgtggggctgggaattgaactagatccaccaacttagcagcaaatacctttactcagagtcatctcccaaagtccccctccattgtttttcttcttcttcttcttcttcttcttcttcttcttcttcttgcgacctctagctactgggttttctgggtggattttggggccagttggaactcagcacaagtttccttagtgtaaattctctttttatttgttttggggtttgttgcgggagttttgttgttattgttttgctttgtttttttgttattttaagacatgacctcactatgtagaccaggctggcctcagacttgtgccaattctcctgtctctacctcccaggttatagcattataagcatatgcaaccacaaccagcctggtgtgagttcttttgcctatgaaaacttagttgttacacttccaattaggaaacttcctcaaattacggtgcagatcactaattgtggagaccagaggcatttggtgccattgaacttcaggcagtatgtgggtctctgttaagtccagtctgcttgtgtgggaacacctgctcatgttttggagcagtctggcaatttgaaatgtctcttaggcatggcagacctcaggtagagctgacagatctctgaactgggacaccattaactgtcattgcccatatcagaaccatggctttaccaattataaatcaggggacctgagtcaagttaattaactttcttgggcttcactttgctcatctgtgaagtggggaagtgatagttattttacagtactaaagtgaactttagatgagatataagatctcatgcaggcagatgctttgttatattgagttccttcaagcctatcttcaacactctagagggaatgtattcacttgcttttctttccttatgctttataaactggaggcggcttgagctcaggaactattactcagaggcaggttcagaaagggtgaataccataggaagccaaagcaatggatgcctttcttctttgtatctcagcatacaatgttaagaacaaaatgagttctcatcgacaggtgtgaccaggactcttctctaacatagctcaacccggaatttcatagactgattttttttctggtgctggggattgaactgggggccttgtatgtgcagggcaagtgtcctacactgacctgtgtgcccagcttgctaatggaagttaatactttgtctctgcagcctcctctccatcccttgaacatataccaagctagtttaagctggccaatgtgtggaatgtgggatacttttttctttttcttttttctttctttcattttttttgttttgttttgtttttagacagtgtttctctgtggctttgaatgttgtcctggaacttactctgtagcccaggctggcctcgaactaacagagatcctcctgcctctgcctcccgagtgatgggattaaaggtgtgtgccaccattgcccgggatacttttttctacgtgatactagggatcaaattaaattaaaaattaaacattatattaaaaatgaactgaaaattgctcacaagtaaggtgcagagtgacacacagacacacacacacacacacagagagagagagagagagagagagagagagagagagagactgaggtagatatcttctgtacaccaggctttgctcgcctaactcttatctgtggactttcattatatgttacaaagttatcactatcttcatgtgggaatatgtgctattggataactgacaataactgggctaaacataatggtcttattcctggagccatgcctagtcagcagaaaatgatgccctctactcatgagacaaattaggacaattgtatgccacttgatattcagtactgccacaggaataggaccctggctcaaacctcctcagcatgggaagaagggcataagagaatttaagttgcaaggcagctgtcagatgtctcctctgtgtttcatcattgcatcttacggaatagttgttgatataatgcctttgtatgattttttcccttctgtaacaactgaaatggaagtgttccaaactgaggaaaaggagagaaagtgacttgatcttggatggaatatttataaactgatgaggaattgttttcacccttgggttttagctgtgatggtcaggctgcgtcttactcatctctgtgtccctattgtagaggaagttcagtaaatgcttattaataaacaggtcagataaaacgctgcaaagtatgaaagtggtggtgccagtaataagcactagagaagcccccaaaagaagagatcagtgggaatctaggaagggaatctagctaggaagggatctgtgggaaggggaggagtctcagggaaggactgcactgtttgggcagaaatggattaaatatggaacgatcacagacttccaaaccacttaaactcaatgagcctcattttctcaccaaagcagcacaagtgtgtgtgggaattttgttttttatttaattttaattattttttgacagggtctttccacatgccccagctgtcctgcaactaactcatggtgtctgagttctgggcttaaaggcatgtaccaccatgcctggcaataaagaaaataaacttacatcataggcaaaggagaaatgggatccttgcaggagggattgatgcagaattggtcatttttcctttcttggcatatgtagccattccactgatttgaacattttcctgacagagttctggagttcttaggttgctgagattctagtcttcagtttagtgtatttcctgtcttcctacctcacagcaagcattttccagaaaatgtcagtagggacatgggaagcatccaaccacttccctggacacacaatataataaactggggaatctttgaatgctcctcttctgtttttgtgtttctcctgttttagttagttgctttgtttttaatatgggacctcatgtagcccaggatggcctcaaacctgtgtagcttaggatgacttgatccacctttctgcacctccccagtggtaggattacaggcatgcaccacaatgcccagctcaagcttcttcccagccggagtcttcctttgcctcactgggttcccccaggttcagatgctgttcatgtgtctcaggccacatcagaagctccgttcactctgcatcagctcggctgaggactcttgatttgcccaaaatactgacaaaacactgagggtccaagaggacaggtaactcgtctcaagatcacagagtctacgaggggcagttagatctgaaaccaaagctttgaccctctggtcctctttcttctgtgccctgggtgtccagaaacacaagccagaacaggagccaaggatgatctcccaaagtcatgagcacagtcaggactttaagacctgcatgaggtaaagccaccatacaacacagaagagcacttccaggtctggagacacaagtgacaaatcacctccttgctaggtgtccacccagacacaagtaagcatgcctgcaaggcatttgctcccctccccctcagcagggtttggttggggctacagcatcccgacaacctatttaaaccaacttgcaggaactggcatcaaagtaccatttcccaccaggcttgagcctctgcagcctcggaagagggagtctttagccgaaacattcaggagccggggatcccagaaggtatgtactaaattccatccagatgttgagtttgattttgtactttgtcttcttcttcttttcctccctaatcatacttaaagagtgaacaaattgttttcatgttatcaaacaatgtaggagaagaacgatggttccttcttttctgggcaggtctacaccgaataaatgaacaagacacttacagtgtctgggttacacagacaagcatctgaattcgaaattagcattctgtatattcagcagaattaccaggtggatggactgtattgcaaacacttcagtaaaatgcaaccagcaaccgcaagtcctctgtactttacagcttccagaacaatttacctgtgctgtagtgagcccgtctatttttaaatccttctagaaaactactgttgtacaagtactgttgtacaagtagatccaacagtaaaatgtacatgttactttattagaaagggagactaaatgaaactttctggtggcatctgagcatctcagtgcctggcagctttaccatcccggtaggtaacattcggacacaaaactcttctcctgctgccagcacagctctcctggggttaacttgctgtggggctaggatgaggaaaaacagatcttcctaggctgcagctcacttggctgcccttcagcccacacctgagctcctcccccctggaagagaaacctgaggaaaggcagcttagctgtggctgcactgacaggggcttcttgccagtggctgcttctgactgcaagcggaagcaggaccaggaatcagtgacactgggagcaggaagctcagccaagaagggagctcacttccagtcctcaagatatgggattttcaattttctcatctgaattggtgagtttcaaaattttagtccttagactgtgagcaaagccagggtcttgcctgtttaccaggtaaacacacaaggaaacagagactgttgaggtgttttgttgaactccttctgattatttatggcttccttcaacaatggtttttgttggggttttttgtttttttgtttttttttgttttttggtacttttaaatttgattgaactcttcagtggaaaataggttttaaagaaaaacaaaacggagccacccactgcacttcgggtgccttgcattttgacccagcccacagaatgattcggaagaatctctgcagacctccaagatccttgaattctatatgaaggaccatagatgtgaaaactccgtcttcatttcagtgcccttctttttacctggaattatcctcactgaccatagagagcagttactgatgaatcctgggacaggccctgtgcagtgagaggtgagcgcatctggaagaagaaatttattcctctcagcgagtgttttaattaatattgtgtctatactgtagttctatagctaataggaggcataattatttcttttttattgtcaagtcctctcaacctttctcagtatttaatttagttttgcctctttgcttctcttgtagaaaactttcccccagttttggttttagatggtttgccctggtgcattctgtttattagaattccagaatcacactttctgggtgttatttgggcacaaatgttcccaaaatatgtaagcacttaaatcattgtaaagacagctggccatggagcacatcttgcaggcaggtagccaaaacagcaccagaaaatagaaggatgaaggattgaaccctaccccgtggcagaatgcagagccctactgagatacatggggaaaggagaaggtcccttatggagggatcagccatgttgcagagccaacaacacggaccatcagaagagcaaacccaggcgggaagggagccacccacacctggaagcctgacatcagaaatccaaccagcctccaactgctctgtgaaataaggggaaagagtgagccccacactgaaggtacagagtgtctgtgtgtcatcctctgaagacatggggactccatcatgagggcagtagcgctggtggctttgctttggacacagtctgtagcaggacagcccatgcaaaggcaattaggtggaaatggggatcattatagccctttgatttggttcctccaatatccggtcaggcagatgaagaaaagagactgactcttaactcggaagtaaattgcaggtggaagtatttggtttcagcttctttcaggttgaggctttccaaagcagaattttgtgtgttcaggaacccaaacatgggacattattgctttagagcccttgcagagtcagaaataagaaaacaggcagccaaatggagacaattggttttagtaggctgctattctttacagtgtggtgacactcattctgtgtcagggctttgaaagaggctctttcaggtttcacaagacagtctggaggaatctcaaagtagaaagaattccaacatgccttatgtcacttgcacagggacggtttctctctatcaagcactgatgcctgtggttaagcattcaggcatcaggcaaacttgccagaggttacagtaggactcgggaagcagaagagccaagcagactggacataagtagctgagaaccagagccaggatgaaatattcctataggagagaaatggagctaggaaccagcaagctccgatgtctgccacaggggttcagtccatgtggcacctttgtccgagtcaagaagagctgaactctagaggaaagtgttcacaggcacgggacttctttccacggggtggggaagacttattcagctttgggggaaaataagaaagctgcacagccagagtctgcatccaatctaaatacctgtgtagctggctctgcggcaatttgtggaacctgtcgaggactgctttgtgctcacaggcagctagcttgaggaaaaagcagagggatgggcactgcgacaggggaagggttcgatccactcactccttgactggcctcagcaaaggtagagaggatcccattaaaaatcgcctgctggggagcctggggctcagtcttcacctgcacccctacaatattgttcttatagaatttcaattccttcctctcctttatgggcatttttaggaagtgtcagtttggaggaagcgtattaagtatgaaatgttctaattcaccatatggatcttattacacatgtgtcgggatgccaggtgtgacactccttggatttaaaaatagttttgcactgcctctctaccttctattgcctgtgaggcttttctgcactcattgacctgcccaggcctccatctttgtctgcatcaagtgtaaagtaaaaatgagctgcttctgctggcagggattcatgtaggtgagatgagagcagaacgagaatctgtctcagctgcaagagacggacaagttcccacgctgttggtggtgacaggtggttattctacaatcacttaattttaaaagccatcctcttatcctgccacccccaaactcttaaatattctgagaatatgtagactttcttttttgtttttactttgagaaatggtcttatttgggccaggttggcctggcaactctatgaccttgaattcttggtcccctggacttctcctgatgagaaatgtgcagattaaattgtgcaacccacacttggccatgctttaagtaaaaaacttattgagagaaacacacagtgtttgactaagtgaattttcactgtgactcctcccagaaaaagagaacctaggcctagaaacaagaaatgataagcatggagaacccttctcctctggtcaagacccacctcctcctaagaatagccataacccacccagagtgtttgggatctgtggtgtgtgtgtgtgtgtgtgtgtgtgtgtgtgtgtgtgtgtgtgtgtgtgtgtaagcgcatgtgtgcatttttatgaatggcttcatgtgatttttgcaacacatcagccccatctcattttgtgctttatatattggaaagttcaactcaactttcctttatattagcaaaataaggattcaggcattccacattttggtggatatatctcactaaatgtggcatctatgtggaactgttggcccatacaacaaatgtctggaaggatcaaatgattaatataagacattccttctcattcataatttcagacatataatgctcttaattccaggcgatttcttgtatttcagtacatttatttggggtatgagtcttgagtttagaggttcgtacatgttaagcactctggcctgtgtatcttaatacttcagaatcaggcatttattcccatgataatttttttctcagctcatgtatcagatccttctaaaaatttctagggcacttatacatatgaaatggactaaaggaatatgttcctctactgtttcctatatccactgaagaattactgccacccttctaccctcagaaggtggttcattctttcaaccaacagtatttactgagtgccttctatatggtggttctattccagaccataggaatacagtgttttattttcagacaggtttttatttatgtagctcatgctggtattaaactctcaacagtccgtctgcctcaacttcctcaacatgaggactatggggatgcccaccatcctcagcttacaattcagtgttaaagaaagaaaactcgggggtagactcagttagaaaagcacttgccatacaactgagcctgcacataaaaatctcagtgccggagaagcaaagacagcacgatctctggggctgaagttcaggctcagttagagaccctgcttcaaaaaataaggtagaatgattgaagaagacacctgatatccacctatggtgtgcccatgtgcaagtgcgaaagagtgagtttgaaagagcgcttgtgctcacaacacacacacacacacacacacgaatgcacacttgcataacatacacacaacttgcacacgaggtgtacacacagaaacatggacatatgcacaaaaaagaaagcattgaaaatggaatgtaaatacatatataactagtgtacaaaatcctcaaaaaatttaaattaaaaaaaaagaaaaattgaagaacaaatgacacagggcaaaatttaacagataatgacagtgctaaaatggaaataaataagataaggtcaaaggttaactggaaggtacttactttggagggggcaggaaaactctgaggtaatgtatgggaataagacttgaggaataagaaccagctaaggaaatggcaagtcccagggctagcatgagaaagaaagaccagtgtggctataagtctactaggaggataagaatgaattatcctggaaaagacagttagaggccagatcatataggcccttataagccatggtgaagaatttggacctaggcaataaaaatcatagagttttcaacagtgttccaatgtgttctcagttttcctttttttttttttttttttttttttaaacatgcagacacagttcacaggtaggggacaatgtagattatatgtgtgagtatgatgggttctgacagctgcacaggcagttttccaaaatggctaacatttttattgtcactttgagtcaggttcttatgttgctcaggctgacctgaaacttctgatctcaagggatcctggtctccaagtaaccagtacaacaggatcctactgctgcctctggctacagtatatttttaaagtcctgtcagtatatgttaagaattctcttgccaagtatgttagcagagactgggatgagggtaagattttgaggcaaacctgagctacataacaagaatctgcctcaaaaaaacaaagtaatacaaaaagcaagcaagcaaacaaacaactcaaaattctcacaaacatttggtaatcagagatttggggtggaagtgttttgtttgttgatgttgttatttattgtttgttttaggtattctaatggatacaattgatgtctcacttggctttgtttctttgctgcataatttttttttttgctttgtttttggagagagagtttcttgtgtagctttggagcctatcctggcacttgctctggagaccaggctggcctcaaactcacagagatccgcttgcctctgcctcccgagtgctgggattaaaggcattcaccggctgctgcataatgtttattggtcatttatgtatcatctttcactgtccctgtcccaaggtttagtacttaaagaaaattgtgtgggcacacatgcatgccatggtgtcatcgtgggcgcacatgcatgcaatggtacacatgtggaggtcaggaggcagcttttgtgagtcagttctcaccttccacctgtacatgggtcccgggatcaggtctttaaacttacacaagtggggttaccagttgagccctctcactggccctgcttgtttgcaaagataggatcttgctgtgcaccctggggtgggttcaagctcctcagcttaagacattctcccacttccgctttctgagtacctagaactacaagcatgcaccatcacacccattggagctttaaaaattgtacctgtttgtctttttgttattgaatgggtgttatttgtatatagaggtttttatttcatcagacattgtgtgttgtaaatattttctccagggtatactttgtgtatttatcttataacagtatattttgagtctgagaacaaaacagaaataagcaaataaacccttgtagttagaaataattttaaaattattgaaaaagtaaatgcacgattctttgtgagttgacctttttataatgcaatacctttgtttctgttagttccttttctctgaaatctactttggttgctattgattcaaacattcaattgtaaatagaattcttaattggtctaagtaaaaagaaaaaaaacctgcaagatatcaccacattcaattttgttttgttttgttttgtttgcctagtgttttcatgctatgaaatttaacctaactatgacattacatttgaggttattattattattattattattattattatagataatatgtagttggttcatttaaaaaaattctcctggggcctttagaaatgactcagcaattaagagtacttgctgctcttacagagcacctgggttcaattctaagcacgcacattgatgattcacaaccatctgaaactccagatccagggaatctgatgcatatatatgtatgtgcaggcaaaatacacataaaatagactttaaaaaatcccattctgacaattgtgcacttcgtagtgtttgatataataatgtatgctagaattaaggtctatggctttatttttttctcgtattgacctttgtttctatttcagtttcctatgtattggtttatcatcttgggcagttttggtgagtgatgaaggtattataacatatacatttaaaattgcagtctgtgtacaatcagtgtttcaatcaggggagtattggaacataccattagtatgttttttttcctttacttcccactttacaatgcaattatctgtattttttttttacacttacacatagaaaaccccaacagagaaaaatcatagcctttgcttttaatcctcaagcattttagatgtttttaaattatgtttattttgggaggagacatatgtgtcatagcacatcagacgacagcttgcaggagtccgttctctccttccaccatgtgagttccagagattgaactcaggtcatcaggattggcggcaagcacccttccctgctgagccagctcactagtcatcaaacagtgggaaaacctcacagagtaggaactgagaagtgtttttacctggatagttcccattctgccacttctccttcctccttctggcatcatttccccttgctctgaagaaaccctctctcagcagctgttccagagggagtctcctaacagtgtgttctcattgtctcctgctacctaagggtatccttatttcatggtcatttatcctggctatagtcatcatggcacatagaattcagggagagcgtttgtttatcatgttaaaaatgtttcacttcattttggtgtcaatggttgttgtcgagaaatacacagccattaaatcagtttgcctgtcagtaacatgtcgcttttgtgctgtccaatttcttttgttgttgttttccatttaaaatttttatcttattgtatgtttcctccgtgttgtgtgtgtgtgtgtgtgtgtgtgtgtgtgtgtgtgtgtgtgtgtgtgtgtgtgtgtggtgttgtgtggcataaagtgaggctggaaaaatggcctcatttcttagagaacatacttcttttccagaggagtggggtttggctcaaagacaccagagggtttacagcttcctgtaactccagctccaagggactgatccagtgtctctggcatccttcagcacccaaactcacatccacatacctgtgtgtgtgtgtgtgtgcatgtgagtgccttcatgtacacacacacatacatacacacacatgtacacacacgtacacacgcacacatacatacacacagagttaaaataagtgttttttaaaaagtacccatttccttccaaacactgttgcatgtccaacccactcatgtcaatatgtggtttcaattatttttcctttcaagtagtttctatttttggacctatggattgtaagagacaggtgtgtttgttttcaagacatttggagaattttccaaataacttttcattgtggttcttaatttaatactgttgaggctctatcagactctgtattatttcagtcttttaaaatgtactaagatttttttatggtaaagcatatggcttacattaatgaatagtccagctatatttgaaaagaatgtgttcttttcagtttggagtagaggattcaatagcggcaggcaggtccatttggtttacattgcattattcacaatttcctaactgattgtgtgactgtccaatccatctagttccaggaggaaggtgcagacactggagcagcagctgtgtattcacctacttcttcctttcctctggcaacttttacttcttatattttaaaactctgttgttacatgaatatgtttttagaaatgttacgtttttaaaaaaattgtttgtttggcagtattgggaattaaactcagggcctcatgcatgctaggcaagtgctctgcctctgagttacagtacaagactaaaatgctattgtttaaattacacactcttctatcatgaagaaatattccccgtacctatcgctgtgctcctgtgccctcaggttactttacgggtgtttgtagagccacttcagctttcctgtgactcctcagtacccttctccttttcactgcattagcatgagcctttcttgagagcaacatccagtttggtcttgctttttcatccagtctgggactgtattgatattagagttctattgctatgcaacgaaagactgtgaatttaggagctgttaactctcagtctttcgtcagaagtctgacctggtatatgtagtctggctcactgctacgggtccaacaaagctgaaatcaaggtggtggctgctggtgttcccatctaaaggaaggttctactgccaagttcgttctggttgtcagaattcagctttcctactatctcattgaccattggctgctagtgacttccctcacctcaagagggctgtatgcataaatcttcttgtgacccttccacaacatagtagcagcagaatctccctctcaaccaatccctctcaacctttgaacctctttgacttctaccaccaaagggagaaaatgcttctgttgctcctgccacctgaaaagcatccttattttaacatcaattgaatggtaatactgatggcaagcaggaagtccctagggggcaaaagtcatgggaccatcattgaattccacctactacatcactcctatttttaatgtctttttattttgagataatttaggatatttatgcatgtgtgaagtatgtgtgtacctgtatgtgtgtgtgtgtgtgtttgtatgtatgtacacatgtacgtgtttgggtacagaggccaggtgttgatgtcttcctctattgagctccatcttactatttgagacaatctctttgctgaacctagacccgatcaatttggctaggctggctgaccagctaatgagctttagggagcctctcctctctgtcttctcagtactggggttaccagcttttatatgggtgatagggaaccgaactcaggctttttcaacaggcttttgacctactgaatcatccctgtggcccctaatttataattatttagggaaagctgcaaagctttcatttctgcacacctgtggtcctacttttccattgttctctgtgtgtgcatgtatgtttctgttcgtatggaggtccaaacgcaaccttggtgtcagtcctcgctctgcttcttgtttgagatgggctctcttgtctgcatctgggaacaccaggataagtgactcatgattctgtggagtctcccatccctgccttccatcttgttgagggaaccatgggatgacagcagacactacctagtctggctttttatgggttctggtgctgtggaatattgttttaactgtgtaaaggtgtgctatatttttctgctgcttttgttaacgatgggaagatgtgttacaattgtttgattaaataaaattaatctggggtcagaaggctgagtcagcaactagctgacaggaagtggtagagaggaattaagtgtattgagggctctttagtggggcttgagccaaaggacaccctgttttggggagacacagcaaggagaaaaggttaactacttgctcttcagcctctctgagcaagcaaaatttcacctcaacctttgactcctgagttctatagacatatagaaatctagataaagtttcctctagtggccacaatagagatgtgcctgaaggaatagagttcccacatggctgcggccagtgtggtggaaatgctgctggtagctgcagagatgaaaacaatgtcctggggatcatgtttgcttggcaagcactttactgagatgtctcgcagctctgtttttgtttgttctcagctctgggaattgaaccaaggatgattttgttttgtttttgaggcagcaccttattaaacagcccaggctggtctggaactcaggctcctccagtttcagtctctcaacttctgggattacaggcacgtctcaccacacttggcgtcgcttcctttaatattaacaacttacagaatcatagcatagtgatcaaagctagcacgtttgtattgagggaacagtgcagtcagtgacgttctatcggatctcaccggtttttctctccgacatcattttcataatctgagagctggttgaggtttgcatattgcctttagttgtcatggtacctgttatcctcttaattggtacatcctcttaattaatacagttcctctggaatttttttggggggggtctcttctgacatgaatctttgaagaatactagccacatattttataaaattttcctgagtttaggtttctctgatgctgcctcaacattaggttaaagttatttttagtaaggacaacacagaagtgatgatggcccttctaccatggaatccatagcctattgtcttattggtgatattaatccaaaactcccagttagttagatttgagaaatccgagtttctcaactttggaattattattattataacctttataatagatattttgtaggaatattttctttctttctctttttggggggcgggtgtttcgagacagggtttctctgtgacttttgaaactgaacccaggtcttctgcaagagcagcaagtactcttaacctcagagccagctcattccttttatttttatttttaaaagagttatttatttttatttttgtgtgtgtctaagttatatatgtatgccatatgtgtgcaggtatttacggagtccaaagaaggcattggggcccctgaaacttgtgagctacctaatgtgggtgccaggaaccaaaccaaagtgctcttaactgctaagacatctctgcagcctgaaaggaattttaaaatgagaaatagttcgtcattgcttgaaatattgcatttatttttcttttctaaaacccatctctctctctatctatatatctatatatagatatatagatatatagatatatagatattttcattttaaaaaaatgagtataaagcaacattttctcaaacccagaggtgtttgggggctgcaaaaacagagcaattaacactgctatgaaagggaagaccttgaaaacctttctctggggttttgatttacaagtgcacttgccataggactggagctttggttaagagagaaaggggccctgcaaaacgccggagattaaggagaaacagctgtagtaaaaagcatttgactttaattgtgtggaagataattgggcccgtttgatttctgaaagatttagaaacagagggctccagaggaaacagataatgactggagaattgcagtacaggaccgtgagcttccagcctaagttatcctaaggcggattgtctgcaaactaagaaaacacttcaattaacatcttccaaatctgtcttcaggctttattaaagaagctataaatatatcagattgttcagaatggtctccaataaaactttaattattttcctcataaacagactttatgtcctgggttcttttttgttgttttgttttttcaagacagggtttctctgtataacagccctggctgtcctagaacttgctctgcagaccaggctggcctcgaactcacagagatccgcctgcctctgcctcccaagtgctgggaataaaggcatctgccaccacgtcgagcatgtcctgtgttctttggcttaagattctcatcatttacatgtcagaagttctggagatctttttttttttttttttttttgcttctccctttcctcagtccttcctgacagaacaaagccttagtttaataccaaactactttggactcattgcaagccatattcaattatgacacgcaagacaccagcacctgcaggtctcagtcatccattttaggcaaattccccctggaaggcaggggtctcctcaaagctgggtattctgcaaagataaggaaacatttgctttagtgacctcttcttgctcagatccctgcagctaatttttcattttgatttcacgttctcttacctacagaaagcttacaaaggcatgtaagcttcagaatctatgaaacctggatctgcccctggactcaccaaaaagcccagcactgagtttttattgccaaatcatctgtccctcactatcccatcccagttgtgattggtcagtaggcttcattctattattctgattccgtctttcacaggacaaatgtataaatatttagattctgtctcttctcctatttagagagttaacttagtcagagggggcctttcccagtttcagggctcatcctgtctggcctcttactgacatcttgcccatcttttctctcttctgcttccattctttttaaaactattctcgcctgtcagtggtggcacacacctttaatcccagcactcgagaggtaaaggcaggccgatctctgtgagtctgagtaatctacagagggagttccaggacagccaaagctacacagagaaaccctgtcttgaacctcacccccaaagtatttattttttcacaatttcatacatatataatgtacttcaatcatattcatctcccccattattctctcatgccaagtccttcttcccgacaaactcccttgcactttcctgtcttctgtgtgtgcaggtgtgcacacactgagtacccactgcatttaattaggagtgcttgcactaacacaggtgaggttatgtacttgagcaagggcattttaccagtggctactctacctaggattatgactccataccccagcaaccactaactccctatagctcctcagggagggaaggggcctcacaagccctcagacttctttgtggagacagaacatctcctttgcccctagacttgagatttaaaaagaacaattagcagaataaacctttttcgtgactatgtaaattagagaaatcttatgactactgttttgtttgttttattttgttttgttgagatagagtctcactatatcaccttggctgggctagaactcactaagtagatcaggctcactcacaactcacaaagatccacctgcctctgtctctgccttctgagagctaagactaaaagcatgtaccaccacacctggcccatggctacttgctatatgttaaacatcttaattcctagtccatgtcttctcctctcacatgggcatactctacaaactaagtcagtgaatggatcagcattctccacatatgactgtaatacatgtcttagggatctcattgctgggatgaaacactatgaacataaatgacttgaggaggaatgggtttatttcagctcacaactctcaagcattatctaactttctgttaatctctccagcaaattttctttttctctttcattcctccttcttaattttattttttacaaggaatcactgtgtaacctggctggcctggaactcaccattggtaaatttatcagggatgccttccatgtacaaatacaaatgtaggtcaccttaatttggagcttcatatttaatgatgagggtgtgggaatgcaagctgttcctcagctatgataagtctttcaaaccaacatacctttcagagacactttgcttcgcataagaataaagagaaaatagctggctcctgtgctcatttgaaaggggttttgtagtagcaaagctgagttaccctgtgtgacagcagaggctgtgggctgtgaggcactcacatttaggatgtccacatgagatttgccttttgaatatgtttggtttattcacacaagcattccttacattaccatgctgttgtagagattatggaagtctcttgaaaacaggctttgggggggggcggggggaggttaggaaatcctgcaggattctactagggagtcctctccagtgagagcacattgggaggaagctcaaccagcatcctctgggaggcccttcagctgtggaaggccaggatgatgacactgtctgaagtgcacaaggtccttgagagcattggacagtggttagcactgatttcagaacattgccaggaaacttgactgtcactagtcactaaagttagagctacagttgtcagtctcaaaatcctgttaccagtagggatcattgcagaggtttaagaagccatatctctgaagcctggtagagccatcctagggctgcctccaaagtttcagtttttgtattgttcccatgagctttaagctttgtattatcttggctcacagataagagtttatttattaacaaatgagagccaccttgggtggttcattgacatatcagagcatgccttaggcttggctcatattggaactgccttgtagttcactccttacctagaaagcattgcattagttctagatacacaaaatagttttcaaggtacaaaacaatggttccacttatgttactaacaccctgttctccaccaactacacatatttccaaagcgctcagacttcagcaaggctggggaaggaaaacatggcagaaggattagaaacacagaaatatcaactttctgctgggccttcttaagggccttctttgtcctctaatgcctctctgatttaccccaggaccaaggcgggagctgtcagtagctcagttaccctggaggaggcagagagcatcaacagatgtttggcctgccttcaagacaggccacctctcctcagatggctgtcagtcaataagaacttccacatccctttgaagagtcacagcttttctagatgagaggaaaccggcaccagcttccagagaggacagagcttaaatctgtagactccagggcatgaggagaaaggatatagcctgtactttgaagtgttgtttctgggcctgccccacttgcttagaaacttgacttcatccacatctgtcctccaaagcagatgttgatgggaagaaggtgggcagcacaaagagatttccaatggggattcccagatgtgagctgtgagagagatgaagcacagccccgctgtcaagttcagggacaacagtgttcctgttctcttgagatgtgcagccaggcagttttaaacaaagtaggatcctaaagtaggaataggtgatagagttccaccctttcttctattgcctgtcttcttaggctaaaatgatcttactttcccagtcatacctgatttctgtctgggaagtaactgatctaagttaggacaattaaatagagcttggtttcctagtcctgatatatttgccaaaacaattctatgaaggtggcaagatgaacagaaaaatatggaatctttgcttcttaggtactatgaagagtcattttagaagaggcagtaaagaggatgttacaagggcctggctgtagcataagctaatagaccaggttagagaacagaaaaagaggaggctcatctacacactgcttgcaggcagctttctaagtgactcctcgatatttgaggtccattatatgatcagtggatattttaaactgtgtttaaaacttataaccttggcattcaagacccccataagtgttctaaatgtctccaacctcatttcccactactaactttctattagttgatgaataccctgtctattggtttaacaatctgattgggaacaccagctatcaggcttagaaatttatctaatcttgtgttggagaaatctccctgtcttccattggcttgatatagtcctttggttaaaattctggcaaattttgtgaacatgtaggctccacaagggcagagactgggtcccttctcactgtgtatcttcagagcctcattgtccaacatataagagacacttgattcatatttattaaatagatgaatgagtgaattgaggaacaccttaagcactagaaacaagtagaatcaagatgaccagagagtgagtggctggtgagaggagaagacagaacaagaacaaaggctgatgctgcttcctgagatctaagatgagccagctttatgggaattcctttacagagaaatacatttggcgcttagggatggaagaattgggatggacatcaaagaatgaaatgtgacaggagctgagggacagattgagctggtgaggcctgagccagagaacagaacaggggagtcagtggccgagagaatcaatcaccaaagccacagcgccagggtagatctattgctcctgacaaatggtggaagagtgaccctgacacttctggcctggaaaatgtccttggagatgaggatggcagcagcaggagaaatcacagaaggggtgggggtggggcagtaaaatgacaggttaccaaatcacccccaaaacttgcacagtgaaaaacaatggcggtatgtcaagaagatctagacaattacattgaagtatccatctctaagggcaactaaacacacttcagctacactggctcctacagttcagttcacgtccccagagtctgttctcataccagggctgggttaggcctggcctcgtgggtaacactggcccaactgttgacaatagtttcagccctgtcctgagccaagacacttagcagctatcagtgtgaactttgaggacttgagagagaagtatcccttgtactgaatgttgcctactaaaaagtagttgccttgaaatccacagttgaactcgttcctcagcctggactattctttgcccattcttgccaggactaagccttactcagccttcaggttttagtttaaaggtcattgcattgtattcctgcatctgatagacccaagtgagctacagcattcacaaaaatattataaatgatgatgaacctgtcaaaacttcttagagtcacttcttgcaaacaacaatattattaataatgagttgatgataaccaggcataaaactcaaatgatgttacaaaggacagcttctcccttctcccccagggttcttgcacttaagaaaatcaggcaggaatactacatgtgaaataagacatttcgggaaagcctctgtttttctgatctggtcttctgctttcatatgaccactctggctttctctccatcttttcctctgcttttgtctactcgatcccttccttttgtctgtgtgatattacacatgctccccagatttcagcatttactgaaatcaagcttcattgttttctttttcctttcctggtaatttgattcaaacagcccagagaagagtcctgttttctcatgtgttgatacaaataagaaccaacaatgctctgtgatctgggaccagaagaaagaggtacatgagagttcacagccagcggccgcaggcaccactcaatagtttgttctgtaaaaattatctgcctcctattcttacctaaggacataaatgcagttttcaagggtgccaagtgcaataagtattagctatacaactctttaaaatgctttattgcctgtcagtggtagtgcaagcctttaatcccagcactcagggggcagaggcaagcagataatctagtctggtctacacagactagccagggctacacagataaaccctgtctttgaacagacaaacaaaacaaaacaataaattagtattattagctggggataagggtcagttagtagagttctttcctagcatacatgaagccctgggttcaatccctaacaccacataaactggctggggtgaaacccacttgtaatcccaacatttgggaggaagaggcaggaagatcagtagcctacatggagagactcaagccagtctgggctaaaagaaatttcatttcaaacaacaaaacaatcaaaaacaacaaaatataaatctcattctctatctcattttattcttccaacacacttggaaggcaagtgctgttactattttaatccttagttacacataaggaagatgaggttcaaaaaataaaattacccaaaccatccatctattaattgccacccagtacacttcaagaagcccatctccatatgatctgttcattatgctacaccaaaaatagttctgcattacaaaaatcagagtgaacgtagaactgtaacaaataacaaattattttctacactgagaacctagaaggctttgggaaagtggtaatgcagttcaacccttcctagacctcttctgccccacagtatctttctccctttctctgagagaatatccagaagcatcttttggaagtcagcagctgctcagaagcagtttacacttgagtgagttattttctaatcaggcagcatcaggattaggctttcaagatctcagtgacatcatttttattttagtttttgctcatggttcctcacttataaactccgttctctggggaggttttagacactagagttttcttccctgtggagggctacagcaactttaatttcccccactttcctgccttcaattcatcataattaaattctctaacctaccttgcatgacaataggtcatcagaccctcctcatcctaaaagtatccaggaaaaaggaatgttttagagagggcaaggagaacgtggttatacaggccttgctaggtctccttgttctgtgtattcacaaccatgcctatgcagtaagtctccatataaagtcagaaggactggtcaagagtacttttggatagtgcaacatgtggtatcttgatgacaagcctagagacagcatggaagctctgcccacatcttcatgcatatatttcttaatctacatccattgtcatgtcctctataataaagtggtgaatttaagtgtccttctaagttctgtgggctcctggcactcagcaatcaaacccaagcagaggattgtgggaacctccatatgtagctgattcatcagagccacaaggaaaacaacctaggacttgtaactgacatctgaagtgtgtgagtgatggggacacttagaagtgtgccctcagcctgtgtcaagaggtgctgtctccaggttgactgtctcacaactaaatgaggtcatgtagctgattctgctactgcaggattgtacacaagcatgtagcaagaattcccaacatgttgtcgggtcacagcatcttccatgttggttgtagtgtaacaaccttgcctggacaatccccaaagccttgaacaaacattcaggttattctccttcaacccatccttcatatggtcaccaataatgtttcagaagtgtagaatctgttcatgtccttcccctctttttttaaaaaattatttattgtgtacagtgttctgcctgcatttatgcatatcagacaatgacaccagatcaccagacctcagtatagatggttgtgggctactgtgtggttgctgggaattgaactcatgacctctggcaaagcagccagtgctcttaacctctagcctgcccttctcctcttaaaatcacttaattgctcctgctttgggctaaattgtgcccctcccaattttatgcagatgtccaacgccagtatcttagaatgactcagtactgaagattggtaattaaaagaataattaagttaaaaggaggtcagaaggatgaatgctacctcattatgactgatgtctttataagaaaggaaatgcagacattgatgaacacagagggaagacagcatgaagacacttggaaagcacagccaggtacagaacaaagagagggccctctgaagcaaccaaacctgccatcaaattctcacaccagtgagaataaatatttctgttgtttaagcaacctacctaatctctggtgctttgttatggtagcccttgttaaggtttcaagatctacaacataagcttaacctggcattccaggactttcccaatgatcttgctttgcatgtccccacctttctccacaccatgtagaacactgaatgtgtcttgagtcctactgtgctctatctgcgtctcactttatctcctaagtctcagcctccactgccctcagcccaggcagcacgagcttcccctcctctgttggaaggtatctccctatccgcaggttccatcacaaggcacagtaacgggcacatgtctatacacatctgtcaagccaaaactaagcatggacggaagggaaagtgtcagggaaaccattctctgtcttttttcctcatagatgaagagcctctgaccattatgtcaccacctcaagctaacaccttgtctcacctcaggtttaaggaaaggctggccctgtggaaactaggacattgagaacacaacttaggagttgaactgtctctaccatgtcctcctggggcctccactctcttactcactgacttctttagattccaagttctgtctcaacaaggatgctgctgtcaagggggttcctgggggaagaagggattctctctctgtctctctgtctctgtctctctctatctgtctctgtctctgtctgtctctgtctctttctctctgtctctctgtgtctctctctgtctctctgtctctctgtctctgtctctgtctctctctctgtctctcccactccttggcctgtatacaattaaaacaacaacgtttaaaccttcctccatgtaaccagggtaaacaggcatggcagctccaggtttacatggcagcatttcagcatcccaagagaacaaacaaattctcacttcagaaaaggactctgagcaccattcttgcctcacaagactgctccttgtgccagctgcttttctttcaagaggaagagagactctgtttttccagtgctgaggcaagttcttcctcctctgctcccagtcccacacacatctactctggctaaggggatgggcgtggggtcttcctagacttattagctacaacacatgttgcagtgagtgctgacacaggcctgcacacaaatgttcatagcatgttatcacagccagaacctggacgagacacaaatgtctcgtcagtgggtggggagataaatagtctgttatataaacccaatgaaagctcagcatagaagggagtaagcctttcaccctgagtaaacttcaacaacagcaagctgagcaaaagaaggcagacacaaaccgcatactgtgtggctccatttaatagaatctttagaaaagacacaattgtactggtttcctggaagtgtgcaagaggtagccttagacagccataagcaaagatgtaaggtaatggtaaaatcctggagactgagtggtagcgatttcacagatgtatacattatcaaccaccagtctcaggcctacactcacatgaacagatccacttaatggttatttacaatatatctgtatataacaagcactgaggggctgaactgacatctcaggataaagcccaggagttgggaatagtccccaaggttctggttgtacaggccttcccttatggtggcatattatttatgatttattaaagtttgcctgaggattcaaaaagcaaagtcagcctcaagctatagagatcaggcagtggaggcacacatctttaatcccaggactcaggagacaaaggcagatggaactctctgaggtcaaggccacccagggctacttgagactgaatcagtcaaaaagagtaacagagctcacgcctttaatcccagcactagagagatataaaagatagaagcagattcttaaggattcagtctcaggattctccagccacgttgaggagaacatagtagtctggaattacagtctggtgtttggtggagccaggatcccctttcagtctgagatagagataagagctagtggctggctcctttgcttttctggtcttcagcttaaagcttgaagcttgaagcccaatatcggtctctgggtcatttatttttcatgctacaatccctcagtgctcccttgtcgtcttcagcactttggcaccatgataattacagttcttcagcacttctaagctgcctgtcacctgagtctttacaggggctgttcctgctgctcatcgtagtccactaagccagaagctttcttcttattcagccccaaattctggaggaatggaagcatctgtgctgccttctttaagcagaatgcaaaacctatcccccttttttctataacaggccacaaatgttctctttttaaaattttcttgtgcattgactacaatagtggaaacttctaaagacaagcgtgaaagaaatttcttccacagaaataaacgttggctatttgaagtaaacatttggaaaatgggaattaaggaaaactccttaatgacttaccctgtgcctcagtctgtactatcattctttacctcccggtcagaccaatgacatcacaatttcagaggaaagctgaggtctggcacaattatggtccaggacattctccccttctcaagcatcttaaacaatattctcaaacgtttattctaattatgaacagttttcctgctaattattaaatccatatgtattccaagagaaattgaatcctggtttgcttcattcacactcaatccatcacggttttactttcaagagctatttgatgttcaagaatccattagagccccataatgcctctttctgagaaataggatatgggcaaaattaagcaaaaccaaatgctcacaaaatcctccgagattaagtagaatcttaacgaggggaattatgctacactatttgctgttcggactcttcagactccaaggaagtcagtgtaaccggagacgtctcacatctttatcccacattttctcccggggttgcagggggaaggggactgtggaaagatgagaaaaaagagtagtttgacaggatagaattatttgacattctgtttccagcagtatttcagtctagaatttctgaagactttttgatatgaaacatctaaaattgctaaccttagtatcatcaacattaaaaagtaaagtagaagtccaggatatcttcccctcaactaaatagctaaaaaacacaaagggagataagactgggagaaaaccaggagttgatcctaagcaggggtagtaaaggatggctattagtcaacagtgaaaggtctgcttctgggcctactcttgggtgtgtactactgtgtttgatatgtgtgatgactactcttgattgtcagctgctgggatttaaatcaccgtgcaaactaacttcgggcaagcctgtgagggggtttctaggttaggtagttgatgtgggtagaccaactatatgtgagtggtgccagtccctgggcaggggtcctggactggtaaaaaaaaaaaaaaaaaaaaaaaaaagggagaaagacaggtgagatgcagcattccctgacctctgcttcctggctgtggacacagtatggccagcttcttgatattctagtgctataacttcctccacaaaatggactatatccccctgaactgcaaccaaagtaaacttttccttccttaagtatcctttgtcagatattctgtcatagcaacaagaaagttaactaatataatagtaaattagccaatccaaaaaaaaaatgataatgcatgcattctaggagccactgtcttcttcttccatcatcccaggatcatgtgaccaagaaccagtctgtagcttagagcttgcttagactattcaaagtagccaacgaactgcatcctgcccttgtcttcgctgcaaagccccctccaaaggctcttccctaacactttccccttgccctgctctctgcaccctgagaaccctgtgtattttcaacaaggctcctggttctaggactgtgtccctgactctctcctttgtctcctcatgagctgcacctgactgcccaccacattaaaaaaatccaaacattctctaacacaccatgggacaacacattgaacataccataagatattgaacatattttgtgttgcaaataatattgaaaaatcaattttatgttctaatttgcctatttttccagactttatggcccctgtctgttatgcaattttaatagtaataagatagatctgttggtactggcatgggaaaaaaaccacaatttattaactgaggaaagtattgactaaaatgtatcttatgatgacagtctcataaaaagaaaaaacacaatctgtgtgtatttgtatgtacataataaaattctggcagagtttcatttcttatttctgtatattgttccatttttatgagtctttattttccttataacaagaaaaacaatataaatttctagttagagaatcctgaataagcaataggcaagaccacacttggggctgagtgaggatgtgtgatcactgtaaagtggccaatgctttgtcccaagccatctcttcgggtgctcaaactgaggcttaggggaaagaggtactagtgtgggtgaaagacctatggttttcatggaggaaagagttagagaagagaaagtgcacactttctctctctcacctcgtagtagtagagccagagtatggagaacataggtctacctggaaagaagacagcactacaaggatattaggttatcagatgatgttaacatgagtctcttggtgttactgttgtcatcatccctctcctcctccccttccttctttcatttctctcctctgtctaattacatgaaaatcttgctaaaaggtggaagagatacagctggtctgacccttcattctactttatatgttccgatccagactcaggactaatcagatattagctggtgaaagaaatgagatagtagggagatctcttcatggcctccccagtgatcatctcagatacgtctgtgtagtcagcagggaactgtctggtacagaagtctgtaaggactttttcagcctgttcctctgggatccatgagggttgctatcccatcccaggcaaccacttattaagagaaggatttattttgcagtcattcacaccagatcctatttgtaatttaacagcttagaattagaataataaatttcctatctgcctaagttctctgtgtatactcctgtgtaacttctctgggatttttaattcatgtgtcatctacaaatgtagtcaaaatgcagctcattgtctagataaaagtagattttctattgcaataataccaggtgtgtgtgtgtgtgtgtgtgtgtgtgtgtgtgtgtgtgtgtgttataatctatggatttaagactattttttgaaacaatgtctcactgtgtaatctgggctatcctagaacttactatgtagaccaggatagcctctaattcacagatccacctacttctacttcttgtgtgctgggattgcaagtgtgtgccaccacatccagctttagttttttgttgttgtttgtttgtttgtttgtttgtttttagtttcatgtagcataggaatgacacaaatttgctaggtaggtaaggctagccttgcattcttgttgcttctgcttctgcttttcaaatactaagattacataggttagctgccatgtcaagacacagagtccaactgttggatagtaaactggctgatttgagactaaagaaagacaaaagcaaggaaatggacaagtgtataatcctatgactgggaaagggttaggggtgtgctcaatgcttatggacaagctgaaaagtagaatagggaaggagagtaaacttattctaggctctatgaatgatatcttcttccatatgcttatctaatgaaaatgcataaagaaaggaatttaagtattttagctgttctgatagctattactgctcataaatagtccagattctctccctgttatcttcttccctgtcagaggattgtgaattctgccttagtgaactcctaaatgaacctatgtgttagtcacactgctatgtaacatattattctaaaacctagatttgagaaaacaaattttatcagggcagtgatctcttgtttactggtgtattctactatcaagaatagtacctggcacttagtaagagctcagtggtgtttactgaatggtaaatcctgcttcctattttctcccattaatccagtctagtttgtctacagattttctgaatgtttttggttgagtctgatcagcacagcagttcctaagtaattctgacctcagaagttaaatgtgtctgttggctcctgttctcattgctgtgacagaatgtatgacagaaggaactaaagagagggagaggtaaccctggctcatggtttcagggcagatagtccattgtgtgtggggagtcatggaagacttcattgcagtgagtggaaggaaacaaatgagcttcagacaggacaggctttcagccaaggcctgttctcagcaacctactttagctagctggacacacccctgaaatgtcccacaacttccccaaacagctggggacaaagtgcccaagcatggagcctgggaggctcatttgtcattcaaagtgtatttataagctctaactgaactcttcagtaaatctactggatctggtcaatattttcatgataatcttctggttgtcactagttgcaagttgtaacagaaacttccacattctttttagatatctctctgctgtccttatatctatttttattctcccagggttgtgaaattatttgagtacttgtgcattttaacaagcaacttgatatcagataattaaaataaaagtaaggctgggtggtgacacatgcctttaatcccagctcttgggaggcagaggcagttggatctctgtgagttcgaggccagcctggtctacaaatcgagttccaggacaaccagaactgttacacagagaaaccctgtcttgaaaaaccaataaccaaaaaaaaaagaaagaaaagaaaagaaaagaaagaaagaaaaagtgagtattttaggcaacagagtagattcttgaggaaaatattgctagctagccatgtcacctagaagagacagtggcaacacttgtctgtctgacattcactagttcttagagacaacacaaagatgttgcaaatctgtccctgagctttatataggatactttaatgaaatacattctccatttattaaatatggttttacagagctaataaagaaacattaaaggcaaaccttttttatatccaataacactcaagagtgggatctgccttttctccccaaacaactgcttagttaaattgatttgtaaggagaacagagcctagagaagactgtgttctgtttactgacacccttagtaatgactacagcctgtggagaatttatggccatccttggagctgtaacaaggaatggaggaagataaaacaatatacaatgaagtcagtgtattagagtgagagaagaaaagactagaaatctaagatctgcagtctggtccctgctttgccgctacatgtgtggcatgagcaaattgcctgtcttgtccagatctcagtttctttataaggtgttaggtttagaatggatggctcagaaagtcttttacatattagtgtgaatgtgggcatgtgacagaggataactttcaggagctgcttccctccttccaccaaggattgaacttgggtcatctggcttgcacaaaaagtgctttttttttttttttaagaggactgtgtagcctgctgtgtagccctggcatggcctggaatttactatggttgtataaaccaggatgtcctttaactcaccaagatccatctgcttctgcctcctgagtgctgaaactgaagacatgagctaccatgccacatcaagtgcttttatctgttgagtcacctcactggatctctgtttgttattggtattattacataaatcactttattataatgaactctcaaacaaaagcatcacacggctagagtaaggtaagcactcacacaccaaactctgtccctctcagtgaacagctatacagtcccagtggccattctgaagcaatggagcttatatacacatctctggtatcagaaggtatgtggagatatgcctgattatcatctaaaatcttataatttctgggtctcttggggaaacacgtgcaacaaaaatggcatagctgtttccactatggtcagttttcctttctttcattcttttctttggttttcaaactattaatagcccactagcaaaattcctgagactctaaccagaagacaatgagagcaggctgttgaatatcactagacacccatcactccacttatttaattgactgttcattcattccctcagcaaacattctgcgtttcctatgtgcaagacacgaaacaaaatagaatacataatggctcttgtcccccaggggctcagcctctaataaacagaaaataaacacagataagtaacaaaccaaagaaaacaagacaaacaatataaataagatataaataaaagtaattaaacattcatggaacaaaaagaatatttcctaccgaggttatatggggtccttgacaggaggaaaagagaaattcaaaaggaactggttattttaaggggatttgttttgtttatctagtagaacgataacactattttaggaaaacaggaaccggaagaaaaaaaatgcttagaggaagctagagataaagaggccaagaggcggttatatacctggaagaaaaataaacactaccgggtgtgaagctcccccacaacctcagacctgaacaagccgaccagcactgaaagggcattggaatgcagtttagagaaggccatttgagagtcactccaaatgggtgtagtttgttctttagaatttcatcccaggcttcttaagggttttaccaatgagattgtagatttgctgttagtaacccccagggtagagacaagaaaacatggccacattttcacaccttaaaaagggctagcctggtaagtaatttgcattctgatcaatattctaaaatccagccatcatttatgagcaccaagagaaatgtgaactatagaaatgaaccaaagtgaagtaaagccagccacatgagataacctgcatttccttgattgctgtggctggggaagttggatgaaaaacatcctccagaacctggacaaaagtttttatgaagggcatgtacttggtcttaccacttcaacagctttttaaattaatgttggcaatatattcttctctcataaaatacatccctgccacagtttcccctccctctactcttcccagctccccaccccaccccatttccctctcccctagatccactcatcatccatctcccttcagaaaagagcaggcatccaagagacagtcaaacatgacaaaacaacatacaataaggcaaggcaaaagccctcacaccaaggctggacaaggcaacccaataggagaaaaagagttccaagagcagacaaaagagtcaaagacacatcactccacagttaggagtcccacaaaaacaccaagctaacagccacagcatacacatagagaacctggtgcagacccttgcagacaccatgcttgcctcttcagtctctgtgacctcatatgttccctgcttagttgactcagtggccatgctcccctggtgtcctccagcccctctgactcatacagtctttctgcttcctcttccatgagattccctgagctccaagaggagggacccaattgagaccttcaagtagactctctccggtaacatctgactgtgggcctctgcatccactctcatctgctgccagaggaagcctatctgatgatgactggacaaggcacccataatgtttgtctttctggatctgggttacctcactccagataatttttttctagttctatccatttgcctacagatttcatgatatcattttcttaaacagctgagtagtactccattgcatagatatgtaccacattttccttatccattctttggttgggggacatctaggttgtttccagtttctggctatcatgagtaaagccaaaatgaacatcagttgatcaagtacccttgtggtaggatggagtgtcctttgggtatatgtcccaatgtagtatagctgggtcttgaggtagattgattcccaattttctgaggaaccaccatattgatttccaaagtagatatacaagtttgcactcccaccagcagtgcaggagtgttctccttgttccacatcctcgccagcatgagctgtcacttgtgttactgatctcagccattctgataggtgtaagatggaatctcaaagtatttttgatttgcatttccctgatggctaagtttgttgaacattttgttaagtttgttaagtatttctcagccatttgagattcttctattgacaattttctgtttagatctgtaccccatttttcctctttaattattctgtgtcttttataccatgtatcttgatcccattcatttccccatccctttgcatccaccctctgcctctgcatcccccccccaaaaaaaaaaataaagaaaacaaaatttaagagaaaaatgaaagctgcagcgtgacatagaagccatagtgtgacacaggtctggttccaggcctctggtttctactacactatcaatgctggccctcactgggcatcttcttggacatcctattgttgtcctgtgttgtggagatcctgcagctttgggtctgtgagtcaggtcctttcacttgttccagtagatcgcagatggggtggatgttgggacagcccaagtcctaaccctgggttctgggcctgggcagctgcagggttggtctgaccaccagttctcccctggcctcaccaccaggttgggctctccagcattgttctggctgattcactttttttagaaatgagtgaggggtggagccagttctcctgcttttatatcctcagggttagctctgccacacctatctatactgtgttgccctggcgaggtacaggatctatgctccagagtgctgcagctggtgaggtgctgaacaaccctctgttcttatggtcccatggccagctcctccacctgttgcaggcactgatggtcagagggtgggggtgagggaaaggttgctcacaacatcgggcctgggtcaccatctggccagctctgttgcctaggcaaggggcagggcccgctttcctgagtgctgcagctggtaaggtggaggatcagctctcttatctgttgcaggcagtaagaggcaagggggagtgcaattttcccttacccataccgccacatgacagacaggtactgggaaaggctgacccatgcttacaactttggggctcactcacacctccaccgcaggttgactctattgtgttacccaggtgaagttcagggcctgctctcccaagtgttacagctggtggagagtagggacagttctgctcttgtgacctcagggcctgttctcccacctgcctcagtctttgatgggtgggagagaaagggcatctctccccagtccatgccgccgtttggcagatgagaggtggggccaggtctcctgtaatcactactttcggggctgactcatccacacctctgtcaacagggttggctccatagtgttgtccaggtgcagtgccaggcgtgtgctcccaagtgttgcaactgatgagggtcagggacagctctccagtatagactgagttttcctctcctggcagccactcccaaataaccaacatagagacttaatatcaattataaatgctcagctgatagcttaggcttgtctccagccagctcttacaacttaacccacttagattcatctacattctgccacatagcattacctctctttcatattgtacctcctgtttcctctccatgtctggctggtgactcctcagactctgcccttcttcttcccagaattctctctgcccccaaaattctgccttgatatcagccaatcagctttttattaacagcatgagcaacacatttttacaatgtacaaaagaattattccacaacactccagttcttatgcccacaggagcagctttcccgttgcctcaggcattgatgggtatggggaggttgtacccatttttaattggatgatttggggggtttttgatatctagtttcttgagttgattaatcttctatctgctgtggagatggtaaaaatctttccccattttataggctgccatattgtctgaatgacagtgtcctttgccttacagaaggttttcagttctatgaggacacatttattagttgttgatcttagtgcctgtgctattggggttctgttcagaaaatcatcacccgtggcaatgagtttaaggctattcctcactttatcttctatcaggttcagtgtttctagttttttttttcttattaaaaattatttttattagttcaagttagggaacaagcttgtttcacatgtaccttccccatgtgtccagggccagagtgtatcccttcacgtgggatgggctctcaaagtcccttcttacaccagggaaaaatgctaatccacttccagaggctccctggagtgcagaggcctccttattggcatccatgttcaggggtctggatcagtcttgtactggcctccccgacagcatctggggtcgatgtgctctcccttgttcaggccaactgtttctgtgggtttctccaacctggtacagaccccttcaatcttcattcctccctctcttcaactaagttccagatttcagctcagtgtatatctgtggatgtctgtctctgcttccatcagccactggatgagggctctagttcctggtcagtcggcggcggaatccagtgtttctagttttacagcatcttttgttaacaaatcagagaagccaatataacctatgcctcagaaataatttattgctcaaaagtagaagacatatctaaaatagtgagtagcagaacaggaaaaaatgtcttcagtagtgtgatacaactgtgatgaaaagaaaaaagattgtgaaatacattgtaacattcaagaacccatttgaagtgtaatgtttaactacttaatctctttgagccattctcctatttatagtatggagataactgtagtgactaatggtagaaaaataggatcatgtattaaggaactagcaagagagctaggaagaggtcttgttcatagcaggagagttaggtagatgtctcagttaattgctttcagtgcaagtaagaggacccgcgttcatttccaggcacccacatggcccttcataactatctgtaactccagttccaggggacccaacaccctcacacagacatacatgcaggcaaaacaccaatgcacataaaataaaataaataaattagctgggcagtggtgttgcacgcctttaatcccagcacttgggaggcagaagcaggtggatctctgtgactttgaggccagcctggtctacagaatgagttccaggacagcctccaaagctacagagaaaccctatcatgaaaaaccaaaattaattaattaggtgcaaataaataaataaaaatgaaacaaggagcttagctatagtaactgttgtctgtggtaagcagaagaaataggaggactagagacaacaggctcatgccactgtgccgaaatttgtgcagtgttggagactgaacccagggctctgttcagcctagtcaaacattccagcaactgagctccatccccagccctgctaagtattgcttacgaattgtctcatgtcgtttcctcttacccagatcacagaggctcttgcttatcaggcttcatcttccttggtataattttctttgtttaatgaccacaaattatattgttcatactaataagaacatgaatagaagtaagcataggaattcaaatgtctaaatctatgccccagatttacttttcctgtactttgaataaattttttccttttataaaaaatataaatcatttaagaagttctttctttggggagaaaatagatcgttttgttttcatgttattgtttagctccaacttactcataaatttaacaatgaaaatagaattttcctggagccaataaagtctcctgtcattccagaaaagtggagggaattataagaacatataatgagaaacattttcctgatattaacaatcaataaatctcaggatcatttatttggtgcccaattagtagcagaacaataacaaggggtctgggaagtttcagaggcaaagatggagttggtgattttcaagtacacacagtttaatagggactgagttatccttagcaagtacgctgggagaacatgtgcagttgagaaggaggtagccagagcagctctttttagacattgttcaccgcaattagcttctggggtgaacagaggaaatgggagagacagagaaaatagtagagttgaagtcacagagccaggaagtggtgggaaggagatttaaacgtagatttttctaggtccatatgtaagatagtctcatgacattctcttgaggaaaacatctcacagatggttcaaaatatctccgatgttaattgaatagacattttaaaaagttgtgtttctaattcaaataaaaaagttggaaaaaaaagaaataaaaaatccatatgcaatatctcctttgcatttgtgaacacatatgtacccacacacatgctccaaataaaacttttaaataaagcctgtttaaaaaaaaaaaagtcaggtactgtgactgagtagaaataaagcaaacaacaacaaaaaccttctagtcccgccccccccccaatttggggactggtaggacttctgaaaccccaagctcaccatgatgcctcaaagaaaatggcttaaatagttgggattttctcatcctcagacaactctctaatattcttcctgaagttctctgtaaaggacacttacgaagggctggagcaatgcctttgctactttttcagacaatctgagttcagttcccagcacccacagaaaaaggacacaattcccttctacctccagacagagacataaatatacatataacattaacaaaagtgaaaagaaagctcatgttactctatattgtaggtctggtagatactaaatttctctaatgtttattgagataattcttgcaaatattttttaaaatgtatgtgggactatgatgaagctgcaataaaaattactggagtatattttaacacacacacaaacacaaatccatgaaacacacatgcagactttaaaggtgagggaacagtgtcctccccaaagcctgaaacaccctgtgagacctttttactttcttctctcatgtttgccagctttttcccagataaaaccatttgccaccattttgtatagacattttaagcatttagggctgccatccatcttgaattgaatgttgtatatggggcataggtatctttcccacagacacccagttgttgaagcatggattattaaataagctttcttttcctcatgggactgatgaggaagctggttcataatcactcaactgcatacgtgtgtctaactacgaacttgatcctgttctgttagtctatttacttgtgtagccagtaataaatcttgaactcagagagggtattctttgctgttttggttgctcagtgttctttgcatttccatataaattttagagccacacactgtcaacatcttaaaaagaacctactgagctctgcagatgatatgaaattctagatcatggaagctgtccccagagagaacttacttgtgtttctaccacttgaagaggtctgagaaactcaaagttgagcttgtgagagcgggtctactgcagtcatcctaatgcccagggtggagccagttctagtaactatggattcctggtcatttgcatagcccttcatcttctcagcctctttctggaggtatctgtcttgatggtcaggccaggacatgcccagagatttttgtgagtttataactgtcaattaccttcagggtgaagggtccccaaacattagcctcacctttcttggcttcacttgtcttctagatcttgaactagcaatcttcactgatttggtagctcctccttgatgtttaaaaactataatttgtccaacttttctaattgttctcagcaagaggtttttctgaaacagcctaattagccaggatttgctgaaaatggcaccatagcatacatttcttaaaactttaagttcattaaagttaactttgttttggaaaaatatgttcagacttccctaatgattctggaaagaactggaaattcctcagaggagtgggtattgctagcatggaagtttggttttagtattgttaaggagaaaaactaccacagaccctcaaattagagagaaagagaccacagcagaacatggtcttgggagctgcccaccaaggctactctgtgtgcctcctggatttactgctccctctccaccatttcaccctcaaagagaggctgggaaaatatcccccttgctcgttacacccatccagtcccactgaggcaaagcggcgtcatccactcatcaattttgattactgagctgtagccacatgtgggttttacaggctccaaacatgtccatattacatgtctaatgtatctagacataaactcaaagctcctaagaaatgggtcatataagatcaggaggctaaaccttatgttcaagtagacagtgttatataaccctattgaatgttgtacagaaagaagtgacccagatgacactttagaaagaacagaaccaagaaataagacccaacttttaatgatccttattatgaaccacatatgatgctaaggcgtcattaaagataattacactcatttattttatgggcaataggggatgtgtgctttctctactatgttggtcccagggactaactcagactatgacttaacagagagcatcttgtcttagttagggcttctattgctgtgaagagacaccatgaccacagcaagtcttataaaggaaagcatttaattggggctgacttacaggttcagcactttagtccattgtcatcatggcaagaagcgtagtggcacacagacagacatggtgatggagaaggacctgagagttctacatccagattggcaggcatcaggaagagagagtgagacactggacctggcttgaacttctgaaaccccacaacccaccctgagtgacacactttctccaacaaggacataccttctaatagtgctactccctaatgaccaagcattcaaatatatgagcctgtgggagccattcctcttcagaccaccacacacctttacccactgaaccatcttgctagccgtaaggcagcttataaaggcagagaatttctaagatctgaagagaaagcagggtagagggcaccttatatttagtcacatgttcagtcctcataatgattgtctttttttttttttttttttttttttttggaacaggctctttgtgtgtagcgcaggccagctctggttacaatcctcctgcctcagcctcccaaatacccattctaaatttaaaaaccatagcaaaggtctcagagctggtgtcttgcagtccaaagatttgaatccagttcttccagatcccaagcctctttgaaagtgtgaaagagaaggaaaggatcttatttaaatgaaatcctattacagtcccgggacagaggtatagtcatgcatggtgtttgtttatagtttccccttcacgggctcatcagcattatttactgtgaacaacagtctgctgaacacttaaccaaatcttccattctgaggttttcaccagtgagggccaggttgtcacagttcatgagagccataaacactagcattcaataactttttccatcacttacacattcacaatacaaagaagagatgtgtaaaatacagttcctattattcaaatctttcttttctttttcaagacaaggtttctctgtgtagccctggatatcctggaactcactttgtagatcaagctggccttgaactcacagagattcttctgcctctgcctcctgagtgctgggattaaatgcattcacagcattttttttccccaaaaagatccttcaatctagacatttggcaattgtttatctatcatgcacacaaaatttttattcctgtaaaaggtaggaagaatataaaataagtaagcctggaccttaccccatgaaactgtgcaaaggtgaattgggctcataaatggatattctcattataagagcatagggccagtgggatggctcagcaggtaaagacactgtggcacaagcctggacaactgatgtaaggctggaagagaggagtgactccacaagactgtcccctaacctctacaaactttgtagtacatgtgccccccattatatgatgcacatacacaaaaatattttttaaaaaatctttaagtaaccacagtatgatagttaatgtggatttttggcttgacaggatgtagaaggccctaggagacaagcctgtggcatgtctgtgatgagtgtctcaattaggttaactgaggtggaaggctcactaagtgcaggtggcagtagcccgcagactgatggcctacaccgaatacgaagaagacagaagctaagcgaaatctccctcctttctgtggatacaatgagactgacggcctctgtggccaccatatgaaccaaaaggagcccttcctccctaagtgcttgtgtcaggcatttgtcacagcgatgagaatagtaactaaggcacacagggtatcacagaaactagaaggggaccaaggaagcaggagcaaaccacccctaggccaacatggggaggcagtgtgcctggcaggaaacactaacatcagtttgggatggaaccacatgatacagcactacagaaagtccaatggtgtgctgagacagagctgggccaggaatacttgcagtgactgtagtcgggccaccaacctttcttctcttgccctggctttgcagctcccaaagctcttctcttttgtgagtttgttttgggttgttgaggggaagggaagttatctgttattttctatcttttaaaaatatgtgtgtatgtattacgtatgtatgtgaagggtgtgtgtgtgtgtgtgtgtgtgtgtgtgtgtgtgtgtgtgtgtgcatttgtatgtatcaatacagtgcacacttgccacagcatgtacttgaggccagaggacaacctcaggtgttggtcctcgcctccacctgttcgagacagggtctctttgttgttccttgtgtataacaaggtagctggtccacgaacttgcatgggttctgtctccgcctcccatctcaattgtaagagcactgggattacaggttccagcaaccacactggctttgctggagagtctaattcaggttcttacacctgcacaacaaatgcctcacccactgagctgtcacccagcccctcctccttccctttatatcttttccttcccactccccgccagtccagcggttgaggaaatgggtaaccttaaagcagactgtgaggcttgaaggagctgtggggatggaaactgttgtctcagttggccgcaatcttgtctttgccactctgtagggacactgaagtacatctacccctaagttgaaatcaacaggacatgtctgcaggcagtaaatgctcagtccatatgtacatttgtgggaaataaatccagtaacaaaacagaataatagatgataaaggacttggaaaacagagacatttagatttatgactgttctttaaattatttattttatgtatagatgtgtgtacctgagtgtatgtatgcatatgttctgaatgcatataggagcccaagcagtccaagctttgattccaagtacccacaatgcactcttgttccgggagatcccacactctcttctgatctccagtggctcctgcacgcatgggtaggcatgtacacatgcctgcaaaaacactcatacatatcaaaaattctattagcatttttgtttatttatttattttgtgtatggggcatggttcttgtgggtcagggtacacaagtggagaccaaagaactcctttcaagaatcggtcttctccttttacatgtgggttctgggaatcaaactgaggtcatcaggcttggcggcaaatacctttacctgctaagccacctcactggctcccttgaagcacctttttcaaaaccaggtatgaagctcaactcagaaccactgcttagtgggcagtgtctatcagattgtgcaaccctgaacactagagagagaaacagtgcatatgttaaaagcagctggtggagggcacccaggaatgtttggcaagctctgaagtgatggcaatgaaaaaggtactccagagaccctcccaaaacatccagggaaaggtgagttgcctcaggggttgctctgactggtgggacttgtgtcaggatcccagtggcctcaccctacccagcctgtgactgccagactcctcctgtctgccatcaaaccattcagccccagcagctctcatgttccaggagaacagttcacacagactcactgagtactcgtgagccatttagactccagagagttcatgaaaatgatcctaacagcaatgaatcagaaacattcatacctcttcttaaatgaccctgtggggctggagtgaagagggacgggactgcccagatgcagaggcctaagcagaatgggcttcctggcaagcaaagctccagagaggtctcctgggatagtcccaccaggacctctgaggcaactctaatgagatgatttagcagtgtggtggaccggcctccatgcctcccacactgacctaatcccagttgaaattgcacaagggtgagctgacaaactctggttacacaaagcaagggctaacattcgaggcttgggaaacctgtccaagacatttttttccctttctttaaaatttttatagttaattttatgccccataagccagtggagctttttatttcgtgctagcaactgtatggtgctcaaccttctttgtagattggagctgagctcctttttttctccttatgccctcttcagccctggcattcctctgtttgttatgtaggacagtcctcatgtcagtgagtccatctttagatgtcatggttctatggacctactctagttcatttatgtaccatgcaattagggttactgcagttctacagttctcactggcttctgataaggtgtgcttgctatcttactatcattcttttaaaagtatccctggttcttctcacagcttctctcaagttagctctagagacagttttcaaaagaatcaaaatgatgcctggtgtcgtgctgtgcagctgtaaggccaaggcagggggattgaaagtccaacagtagcctgagctatgtggtgagaccctgcaaagacagaaagcaagggctggggagacggctcagtgatttaaatgtttctgatacaagtataatctccagaaccatttagatagcttgttttagttcccctactcaacttcattaacaagaaggataatcaagacatttactacccatctaccaagagcattcactgccagatacttagaaaccctcacaaccctgaattctgccctagagagccatagccacggctttccacaaatcatgtctctgtcaatatcttatctgcccaattcttggatccaatgggagagagtaaaggacccagaaacaaaaatgtgtagctactaccatgtgattcccagcaaaggtgccaaaagcacaaactggaaaaagacaacaagaaatgttaggaaagctggatacccacgagtagaagactgaaactacatccgtatctcaccttgcaagaaaatgagtccagtatggatcaagggccttaacagaacacctgaaagtttgaaagtgttcaaggaaaacattaaggaatctagacagaggtgatgactttcttcatagatctccaatagcttagaaagcagcaagaattgacaaagggggtcacatttaaaaattaaaaacaacactagaaacaattaccacaatgaaaagatagcccagcagggcaaggtagtacatgcctgcaatcctagaacttgagaggtggagtcgggaagaatgtgagactcagtccagcttgggttgtacaagatcttgtagaaaaaaaggaaaaagagggaggaggataatgagaaaaagagaaagataagaagtcttcagaatgggagaaaacctttgactaaggaataagacccagaatatataagaaattcaaagacttaaaatcaaaagggcaaataatcctaccagcaaatcggcacatgaaactgcccgattctcaaaaaaaaaggacagatggcatgaaaaggaatttcaacatcttttgtcatcagtgtatcaaaactacactgagattctatatcccccagttagatttacaattgccaaagaggaggtgtaaaaaaacctcaagcaacagccaggtgtaacgacacaaaaatcccagcacttgggatatagaggcaggatcaggagttcaaggtcatccacagctacaatagtgaattctcatgagcctgagctacaggagatcctttctttaaaaaagaaaaaaaaaacttttgaggatgggcagtggtggcacatgcctttaatcccagcagagaggcagaggcaagcagatccatgtgagttcaaggccagcctggtctacaaaaagagttccaggacagccagaactgttacacagaaaaaagtagtagtataccactctggaagtcagaatgaagattcctcataaaactaaaattagaactcccctaagattcacctggaccactcctggatgtacacctgaaggaaccaaagtcagcttcctgtagtgatatgtgcacacccacatatcactggattattgcggtgtttattgcggcattattcagaaatgcaaagtcatacaatcagcctaaatgcccataaacagatgaatgaagaaagaaaataaggaatgttacgctgccataagaaagaagaaaattatgttttctgtaggaaaatgggtagaactggagatcatgttaagcaaaataagtcagacacagagagatgagtatcacatgttttctcatgttgtgtgatatccaacagagaagactgcttagacaagggtttaagccaatagaaaatcttcattacctgggtgtttgggatcctagtatagcactaattggtgagtttttaaacacaaaaaccatgttctgggttgacatacttcagttaacaagaataactagcaagaagtagaacaactacagataccaaaaagcaaggttagtacatttagaggcattcccagaactttggattttgatggattaggtctttgttttagtgttggcaggtggtactgtctttgtgctgagtttgacagcctgaatggtacttccatcatggagtcagttgtgctaaggtctcaggatctactaagtctggggccctgttacagtatccaatccatttgagtgctgaaagggtcatgtggatggtccaggaggatatgcttcatgcagtagattacattatagggaaggagcttgggaaacctgccagtttataataagcactgaagcaaacctggtttttatcccaaagagtaacaataccacaccactcaagcttgctcacagcaaacaagcacagtcctgaaaatgaccaggatagatggtagtcagtccttcgtactcttggcacactaagccagataacactggaagaatgtctcacaacaatatattaatgaaataagtgcaaaatgggtgcagtcactctgaaaattgtcagttacctagatatgctttgtatacgacccagccattcttctcctatgtatctacctaagagaaatgaaagtatatatctatacaaagtctcttacatgaatattaatagcagttggaggatgaaaggagagagaggaggaaggaaggggaatacctcaataaaaaaatagcactttatttgtaacagctaaaaattaaaaatttctgtgaatagtatatggatgaacaaatgtaatatccatgcaggagattactactcggccataaaatgtaatggatgttgacatatgcaacaacacagaaagactatatatgctaggcaagcactctactactgagtatgtccccagctctttaaaaaaaaaaattagtcccagtgtggtggcacacacctttaacaccagcacttagaaggctgaggcaaatggatctctgtgagttcaaggttagtctggtttacataatgagttctaggccagtcaggacaaagaaagaaaaaaagaaaactttttaaaagacagacaggagctgggcatgaaacactcttttaatatgaggaagtgggcagaggcagatggatctcttgaattcaagaccaaccccagtctacatacagagcaagatccaggacagccaggactacacagagaaaccctgccttgaaaaaaaccaaaaataaataaataaaaataatgatagctggggaacctggggcatgaggacttggctcatttgctaccttattcactgaggtcataactgaattctactgattcccaagcataaattctgagtctctcaatatactacactattccccacctatattatgatgttccccctctttttttttaagggcatatgtggtgcattgcataggaagcaaatttagaagaaaatacattcaaatgatcatatgttttgtggttagttatagatatccaatttctagaaatcaatctctctccttgactcttgtgtgttttaaaaatgaacatatataatattttagttgttctaagcaaaaagaaactcactttgtggactaaaaagtaaagtattgaacttctctgattatgaaatactgtttatgagaaaaatctcagggatgctgcctaagtttgaacccagctctatcaattttccacctgtaaaattctggagctctctaaattccagttccctcctctgtaaatagctagcatctagagctagtgtggaggctgagtgaggcaatgcacaaagagggtttatcacaaagctggatggacatatagtgaactaccaattgatattaattatattatcatcattgttctgagtttgacagccagttgtctgacattgattttttaacaaattagaacatcatcttaaacacaggatctacttagttattagagaaaaccttgtatttacagtaggttggaaaaaaaactttttgtgaacaaaatcaaaaagtcagacacatagcccagctcaagaatctcagcacttgggtggtggaaacaggaggatgagtgcaaggtcagcctataccacatgagatcctgtctcaaaacaaataagcaaaaacaaaagaatcagttcaatatgaaataacatattgtaggaaggaatgctggaggactgttctgcccactataatttctgatcagtgcaatttaaattaaattaagtgaaaataattttaattaaattaaaattgctgatctaaaactttttaaacacgagtacaataacataaagaaggaaagatttaagaggactagtgtgagtcttcaccccaccacaattatgtgtgacgatggcaagagcccctcaattccctggatctgttccctattccattcaaactaaagggttgaacaaaaccaacttggaagacttctcaattcttaaacccaataattctcacatcacatatttactcatctttcactggccattaattcccattttagggccaggccctacactaggacctggagaatcaacataattaaatgtctcagctcctgttatgaagcatacactctaaaaaggaaatacaagttgcgccgtgtgtgagtgcgtgcgtgcgtgcgtgcgtgcgtgcgtgcgtgcgtgtgtgtnnnnnnnnnnnnnnnnnnnnnnnnnnnnnnnnngcctgtgtgtgtgtgtgtgtgtgtgtgtgtgtgtgtgtgtgtgcatgaggggaagagggagccctcaccagtgctaagatgtattaaagcagcaactagacaagcactacttatggcctatctgtcccaacctatagctaagtattcaagtaataaacagtagcattgaaccacaccacaccacccttgaacatctccaaaaagtacacaagtttagaagacccatgaaaagtccagtggcagtgtgttcctattaattaggcattgctaaatctttcagcaatttatgagccagttaggtctataaaaacaaggaaatggctgtggtgggataatctgtcatattgtgcctcaaatagatggccccttactccagcagtcctgcgatggcatgaaccttttcctaagcgttttcttctcattattgaaaacagatgctttcttatactctcagattcaactcaaaccctgtgaaactccaggttgtagaattctaaggtgggtcccccaagatctcatccattgtttttagacaaaatgaggcctctggggttcatggcctcaggggagatggagcagaaatgaagctaggacttggggcagagctggagtcctgggattggtgctgactgcccgctggacagctggagggcctacatcttgaccctgactcatgaagtgactcatcatgccaatcatctctgccactctctgcagttgaaatgtttgcctgactcttcctggaagaaagatgagctcaaaaaggaagaaaggaggaaggaaggaagggaggaaggaaggaaggaaggaaggaaggaaggaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcagaggcaggaggatctctgtgagttcgagaccagcctggtctacaagagctagttccaggacagcctctaaagccacagagaaaccctgtctcaaaaaacaaacaaacaaaaagcatattgtattttactttagctttttcattcatcaaacttaacacctactaaaccaagagtaatatgagataataccctgacatgttattgttttttaaataacaattaatagagttgttgtgaaaaatttcagacctccactaatgatcagcagccaagccccagactacaggagggcaagatggtttatgaactctacaagcagctagatgcagtagtacacacctttaatcccagcacttgggaggcacaggaggtggagctcaagttcaagactatttggtctacgtaaaagaattccagagcaatcagggctacacaatgagatattgctttaaaaaacaaaacttcaagcattgaagtatgaatatgtgccaaagcagacagtgaagagtctatatgcaagtatatcaattgattctaaggagtctaacaaaagggtacttggcaactcaagaagaatatagtcatcctggggaggtggtcttagtacagttagataccaaaggttcttagcatcagaagaaatcatttcttccactgccatgagttttcaataacctcagagttgctggaaaccatgagaacaatctctgggattgacagtcgtgtcaaacaagaaacagacctctgtgcaaaaaagctgggcacggtggtgcacacctcacaaggtggaggcaggtggatctctctgagttagaggccagcctgatctacagagtgagttctaggacagccagggcaacacagagaaacccaatcttgaaaaacaaaacaataacaacaacaacaaccccccccaaaaaaaaccctagatttaaagtcataggggtactgagcttgccacacaatttctggagcaggtgtttgtggccccagtgactttttattcccatggcctcagtattcccaatcatctggctgggatccttttgctctgcccaggtaaacaagctctgtaagagttggccttaggtctgggtgtgctttacggacaagtgcacagcaatgactcgcagagcatagcaaccaccctgggattggtcaacaaccagttgaccaatcaacacagggcaaaccctccaagcctggagccccaccaatcctgagcctgtgcgtacccctagacactccccttacacggcccgataagatctctatgcagtcacttcgaactgtctttcctagccatctgccatgggtggatgaaagacccgagctaacatgggttaacttgttaaacaactataataaagtctcatgcagtttgcaaaaaaaaaaaaagagttggccttagggctctactgtttccactgcagcagtaagcaggtaggaactgcagcagggccgaaccccacataccagagttctccagcaggcctcagacccatactcttgcctacattacagctcctgtataggtctaggaagctaacagtccctagctcttagcactagtaagtgttaaagctcttggcctgggatctgatggccccaaagatgtggcaaagcttctggtggccaggacctacagtttctcttctctggttccttacgtcgtggctccccagcttctctctgcttctgttgcccttccttcctcggctgctactgaaccattcagctgcttcttcagctgtcaagcagctggctgctgtgttactgactgctcagctgtcactgccactgcccgttctgtcaccaccctcattgtgtccttgtctcttctttctctgtgttatagaagaagaaaggagcactggaggggagttttttgttattgttgttgttgttttgggtttgtttttttggtcctaatgatacaataggagaagcagctcaggagagcgtctctcagacactcactaagtgagcctggatggtgcacttctatagccggagaagaggcctttggatcaacagataaattttagcagatttttaagtgcctagcagtggcccagtgccccacggagaagtgggtctctcttatctgtctcatcaggactcaagtccaatgttacagaaataactataatttgtataatacatcttcagattttttttaaacttttaaatcagatttgttaacttaattttatgtgagtgttttgctttcgtgtacaggtctgtgcaccatgtggttgctttgtgcttcaggaggccaaaagacaacatcagatcccctggaactggagttacagatggctatgagccaccatatgggtgctgggaattgaacctggctcctcttaaagagcagtcagtactcttaaccactgagccatctccccagtccatgccttcacaaggctttatgactttgctgtaaggatcctaaaccttaccgtgctccaggtgtctttgaggtgcttgctttagctgcaggatccatcacctggtagatgtagagcctagacaacaacacattctacaatgcttgcctccacaccatgccaccagtgcaaactcagagtggagagaactgctattcagtgtttgagggtataacagcctttgtatcttattttgaagtgccttgaacttgacatcataaagtcattaagcaaatttcaaatacatgaaagatgataaatgctgggcttggtaggggcagaaggaatgtaagctcattggctacaagagtgagttcaaggctagcagggacaactaaataaaaccctgtcctaaaatgaaaagtaaagagagggcttgggatgtagctcagtcatagagctcttgcctaatatgttcaagagctggagtgctatccacactatcaggggacaaaatgctgataaagtcttggggacatcagggctacagagatggctcagcggtggagtgcttgctactcttccaggagaccagggtttggttcccagcacccaggtcaggaggctcacaaccacttgtaactctaaatcccatagctccaacactctcctctggcgtcctctggcacttccattcataaacacacacacacacacacacacacacacacacacacacataattaaagataaaatgttttttaaacctttgggaaaatcatgtttcagtataatatactctatgataaagtaaattctgttcagatttactttaggctttgggtccagctagatagtgaatatttaggatatagaaataaatcaccttcacatctctctcctcagtacttaacataatgcctgtgaacagtagaatttatgtaaatgggttacccagattttatgctgtttacaacatttgtaaatcatactgtggtaattaggtttgctttattatccccagagatggcttggggctaggattggtctctgtttcttaacttctgatgcctttactcttgcaaaaccaaaatttattattctgttgctgttctggttaaaattattcattatagttcttgactttttccagtgcatagttgacatttgatataaagttgctatgttgcatcatgatgtttgttttaaaaataataaaactttcttttttactatcaagataaaaaaatactctgtcaattacaagacaatcagggtactgagacctctgttatgggagtgccatctggggcaaggcactagccaattacagtgtactctaagctgcctttaatattatgccaccctctctagaattccttctgtgttttatacctctgggccatgccccttgctcccctatgccactgcctaaacctgccttcaagttatactcccatcctttccctcatctcattgctatcatcaacccaatatgagtctcactctttcaaatctataggacctctataaaattcagaatttattcaaactttaaagtctctagcatttagctaagttactaaattaccaatacttctctcttacagcctgtccaagccatgcttcagcctctgttttcataccttcaatactggggtgggaaggtgggcactgagtgagttcaaggccagcctgaacaactaaataagaccctgtcttaaaatgaaaaacaaagggagagtttggggtataattcaacagtagagctcttgcctagtatatttgatatctggagtgtaatccacaaaaccagggagcagaatgctgatggctcagcagtggagtgtttgctcctctttccaaaggaccaggctccctgaacagcccagcccatcttgggacagttttttttttatcataaattccttctgtatactgtaaattctctttccttggagatgtattaggaacgtggtaaataaggcaaatttctaccactgctgatggtgagaactttgacgtctggcatcccaactactggtaagaatataagggagcatcaatttcacacacctctgtggggttcaaagttactaaaagtgctttaggagagcaatttggttatatctaataaagtttaaagcatatgcttaccttccatttctggcagcactccaaattagtaaatatccagggcatgaacttaagagaaataatagaataagcacaaagaaagaaaaaattaatataaaaggagtcaattaataaaaagaaaggcaaataagccatagaggagattgacaaagtcagaaactgatgttttaaaaatgtctctaatgcaattaagttaagagagagaacacaaggctctggatgctgtgcagcagcaggtgagcgcttgcccagtgtgcaccgggcctggtcctgtccccagcaccacatggtaactgttctaatttgctttcttgctgctgtggtaaacactatgactaaaagaaacatggggacagaaagggtttacttggacttacagctttcaggtctccatcattgagggaagtcagggtgggaactcaaacaaaaactaaacagaaactgcagaggaatgcctgcttggtgattgcttcctctgtttcatgctcaggtaacagtgtcacccacagtgggcgggctggactcgcccacatcagtcaccggccaggtcggtgccccatagacctgcttgcacaccaatctagtcaagaaaagaaaagctttctgccgggcgttggtgatgcacacctttaattccagcactcaggaggcagaggcagacggattctgtgagttcaaggccagcctggtctccagagccagtgccaggacaggctccaaagctacacagagaaaccctgtctcgaaaannnnnnnnnnnnnnnnnnnnnnnnnnnnnnnnnnnnnnnnnnnttccattgggattctctcttcccagagacaaaaaactaaccagaagattggcgcaggcctgtaattctagcactagagatgaaggtaagagggccagaagttgaagagaatctgaggccagtctgggatacatgagattctgcgggggaggggaacaaaaaataaatataaccatcacatctgtaatccaagcacaggccagccagtgggttctagaatggcttgggtcacagaatgagaccctgtttcacaaaaccaaaaatcaaacaaacaaaaacctcttgcccgatgcgtgttaccttttgctgccagaaatcctatggcaggtaataaggaggttaagtaagaccagtgcaaacaatctcaggccaacacatttggaaggagtccaaatagaaagaagaatgaagaaccttaaattgttttatgacaataaaatagagtaagaggataaaatatcttactatattctaaacaatgcactctgatcagcctagattgatagtcctactaaaatttcaggaaagaaaaaatcttacatacatatacaatctttacatatacaacatataatatacaatatattcataaacactgtttccggggcctggggggagaatgtaaagaaaagacagggactgctgaggtggctcagcctataggaaagagtgctgctcttgcagagcacccacacagggcagctcacagcctcctattacttcagccccagaggtagcagacactcagagggaacctgcactcatgtacacatgcccacacacagacacataattggatttaaaaaatctctttaaggagggacaagcctaggaaatcagcttggtggtgaagggcttaccttgcctccaacaaagccctgagttccatcccaatcatgaagtgagggacatttagctcattttatgaaggtcacataactttgagaccataataacaaaaatagtaaaataaaggaaaccatgtgttgtttccactcatgagtagatgaaattattttgaatattagacaatgagatctatcaatctataagacaacattacactcttgagtttgtattaggaatgcaacatatgtttagtaaaggaaatcaaattactctaattcacattaacagattaaaggaaaacaatcacatgactgtaccaactgaaaaagaaaaatataacatccatttgtgattcattttgtttttgtttttgtttttttagacagggcttctctgtgtagccctggctatcctggaactcactctgtagaccaggctggcctcaaactcagagatttgcctgcctctgcctcccaagtgctgtgattaaaggcactggccaccacaactcagccatttttttacatttatttgtgtgttcgtgtgtgtgtgtgtgtgtgtgtgtgtgtgtgtgtgtgtgtatgtacactcgaaggagtgtgtcatgacatggatggggatgtcagaggacaactagtaggagtcagttttctcctcctaccatgtgggttgaggaatcaaactcaagatgtcaggctcggtaacaagtgccttttcccactgagtcaatctctctggcccccattcgagattttttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttagggcaagcacgtgttgggctgttatggctgccgaaaggggagttggtcccttcacaagttaggcaggactaggggtcaaagaggattctgggaaatgtagtagagaagtggtgatccaggcaggaagtgacatagcaaggagactcatatttgagcgaggagaaacaggaaatgccctccttttccccttcctcctccagcggcaccatgtgagccacaggcaagagagggtgccagcgaaaggcatcctctataaagataagttttataacatatatagatttatgataattaagactgagctagcagatgagaatcctagtcattggccaagcagctttgaacctaatacaagtctctctgtgcattaatttgggccttaactcaggcgggaggctggcttaaagcgcacacgtggtggtggggctctgcggcttttggcagaaagatttaccgtaacacatggagtttgtagatagatttttctttggaacgacagctcacaaaaaacaacatgggaacttattattagttataaaagctcagcttatagcttaggtttgttccactaactcttataccttaacccatttctattcatatacatattgccacgggacttatgacttttacctctccttctatatgccttgttccctctgcatccagctggcaactccacctttcttcttcccagagctctctctgttcagaagtctctgctatacctcctgccttgctattggccagttagctttttattaaatcaatcacagtgacacatcttcacacagtgtaaaggaatattccacaactcttaatctgcattttttattatcctaaaaagtttgtaaaaataactttcaaggattagaaatttacattacattgttaaataagctgcataggtacaataccttaaacaagagtagaaatatatgtatactatgttatgttctttttcttatttaaaaaatatttttcattttacataccaaccccagtttcccctccctctccttctccctgccctctgcctctcactcttcctaacccccatccactccacagagcaggtaaggccttccttggggagtcaataaagtctagcataccaagttgagacaggaccaagcccctccttcctgtatcaaggctgagcaaggaatgggctccaccataaggaatgggctccaaaaagccagttcatactcctgggatggatcctggtgccactgccaggggcccccacagcagatcaaatcacataactgtcacccacattcagagggtctagttcggtcccatgcaggttccccagctatcagtccatagtcctctagcttgggtcagctgtctctgtggttttccccattgtggtctcgacccccttgttcatatgatccctcctccctctcttcatcggaactccaggagctcagcccagcacttggctgtgggtcactgcatctgcttccatcagttactggatgtaggttctatgatgacaattagggtagtcactaatccgattaaaggggaaggaccgttccaatagcctctccattattgctaggagtcttagcaggggtcatctttgtggattcctgataatttctctagctccaggtttcaagctttgtccctaactccataatgttccctctattaagatctctctttcattgttctctctctcttccctcccccaactcggtcttcttgatccctaacattcccatcccccatcccctcccttctaccccctcccagtttacccaggagatcttaactattttctcctcctggggcgctccacgtatgtcccttttatggttctcctttttacctggcttctctgggcttgtggattgtagcctggttagcctttgctttacatctaatattcacttatgagtgaatacataccatgtttgtctttctgggtctgagctacctcactcaggatgttttttttttttttttctagttctacccatttgcctgcaaatttcaagatgtcattgttttttaacactcagtaatatattccattgtgtaaatgtaccacattttctttatccattcttcagttgagggcatctgggttgttcccaggttctgactattacaaataatgctgctatgaacttagttgagcaaatgcccttgtgttatgattgtgcatcatttgggtatatgcccaagagtaatattgctaggtcttatgataggttaattcccaattttatgagatgctgccttactgattaccaaagaggtgtgttctaacaaaaataaccttaaatttgtattaatgtacaaaattccataccaatataaaatatttgagacttgtggttgttcaaaagtagactcaacaatccacccttttattccattatttctattctataatcccccttttcccttcagaaacagatccctgaacctaatcctgtttgtttagctttttccctgaccatgatcagtaacaatttgtaaccaacctcccaaatgatgacaaacatccataacccactgaacaaccaaaacccacccacaccacctcttgggaatgtggtgtcatgttctctagactgcttcctgttgtctgaggcatctttggggaaccctgagaaaatcaagataatggcttgaatagtctgcgaggctgaaacatctcagccagcagccttgaaactgttctggatgcagaactctgaagaaacagcaacagaggcattctgagaggctggatcacctgggccacctgttttcattggtgtctggtccccttgttctgaaaacacataaactttcaaaggtcatatatatctgcattaacacaagtatggaatgtgcaatgtgtacaagtcaattaaagatgattttttgttttatgcggttttttttttccagacaaggcttttctgtgtagccctggatatcctggaactcactctgtagaccaggatggtctcaaactcacagagatccacctgcctttgcctcctgagtgctaggattaaaggcatgtgccaccactgcctagctttttgttttatgtttgagcaggtaaaatgtacatctcctgttttgtagttttattaggtttatttttttatgtttgtagccaggattttcagggggtccttcctgatcaaacctggtctatatcaactttgatggaatcctcagcctttcattttctatggaaataaaaagtataacctcttccccaaagcaatacattttctgacttccattttaaagttaaggcattcctaaaataggctggtttaattcagcagtctctcttacaatcccatgtgtctcagcagctgtcatttttccatcagtaatcaaaaaaattgaaagtcaacaagacaccatatagaatccagactctgtatattttccataatacatggcttatcctttttatattattttatttgctctttagagactgtatttcattacttataaactattttttctatgattgtctatacccattttcttttttaagtctatgtacattttttaacatattgtacctctttataggttttctgtgtctggacttggctttactgagtatcagcaggattctgggattgtgtaagacaaatcttaaactgtcatgtcagccactggtccagctcagcttagggaatggcacttagcacatggctctggcagctggctccagaccacaggcagcagccagtggctgcacctttttatgccacggagcactggcccacctgggagactgcaggactaggaagctacatccgactccttgtccagaacctttcttacctttctcaggctctatgtttggatattcaagcccctacattggatgccatatgtagatggatttttctttgggccgacagctcacaaaaagaaaaaaaaaatggggacttagtcttaattataaaagcttggcctatagcttaggcttgtcccactagctcttataacttaaattaacccatttctattcatctacctgttgccatgtgactcatggcttttacctctcctcctgcatgccttgcttcctctgcctctggctcacgactctgtcttttttctttccagagctctctctgtccagatgtccctgctatacttcctgcctagtaggtattggccgtttagctctttattaagccaatcacagtggcacttctttatacagtgtaagggaatattccacaacagtggggcgataaggagatagttgtgcaagtggagcacccatttaaagctgggtgtattgatccatggcacatctattaccgtggatactttggaaggcagaaacaagaggatccctggagcttactggccagtaacttctagctgaactggcaagattagttcagtgtctcaaaaaaaaaaaaaaaagagtgaagagagataaagacatctgctctccacacacatgtgcacacatagctgtgcacttactctacacacatacacacagttgttaaagagagctgttcacataaaaacatactgtagagacaacattttcctcatgctacttacaattataaaatgttgaaagcattctctttgttgaaattaacacacatacttcattttattttaacagcatactggagatcctagttatgccaataagaaagtaacaagaaataaaattgtaaggattttgagctggagagatggctccccagtcaagagcacttgctactcttgcaaaggacccaggtcagttcccagccccacaaggcagctcacagcaatccacaactagtttcaggggatctgattccctcttatgacctcctcaggcatcaagcacaacatggtacacagacatatatgcagacaaaacactcatatgcataaaataaaaaatagaaaggaaagaaggaagagagagagagagagagagagagagagagagagagagagagagagagagagtcttcagactgtttctattcatctagagccagatcgtttgtattgctgagttcattgttgtccttcattgtattctgaaatattagaagttggttaaggtcacggggctagggagatatcttggtagtaaagtactgtcagagcaaacatgactatccaagtgaaaagtaaaaagccaggagtatataacgtcactctcttgcctccatgaatgcacacttgagaacatgcacacacacacacacacacacacacacacacacacacacacacacacacacacacacacacacacacggggggggggggggggagagagagagagagagagtagggggaatcctcatgtcctttatttgaactccacttttaaatttgtttgaatttattgttctaggctcctgataaattacctcaaccttgcaaaacaatttttttttttaatccacatctggcctttggtgatatctgtaatcccagcatgtaggaggtaaaaaagcaagatcaggagtgaaaagccactgttgacccagcctgagctgcaagagaccctgtctcaaaaaacaaacaaacaaaaaagattcacgtcatccaggggcataaattgtgaccttataaattctagctgattcaaagaaaaaccaagagaagagaggcgagccgcagcctaatcctttccggactcggctctggaaccgctccttccggtgctgaaaattggtagaaatttgaaaattatgagaccaatattgacaatcccccaagagaggctaccaattgggcaggccaggcctcagctgtctgcctatctagttgatttagtttctctaccaactgttgcttcgcccacccagaatctcccagagaagctcaattaaaccttgccttagtgggatttgtttttccaggttaaatattaggcctaggtttcttttgtctcccggtgttaattctgaattaaatcctcattaactgtgcctatggagtaacctcatcggaaccacttctcttccatcctctcctaaccctccgtgtcaacaccaatttccattcctaagactctggagaaatatagggtgagcagaccacaaaacttgcagccactgggatgagtctgaacccacggcgtttactgggctaaggggtaagatggggaaggcagctaactaccgggggctttgggggctttaaaatgtctcacaacaactccttgcctctgctacccaaggacaggcttcctcggggaggctgattcggagctgagtcacttgtactgtaagtaggtggaaactgatttctttattctactgccttccaggactctatctctttctctgggttccctttcagacagcctgggctgctggagacctggctataaaattaaaaaaaaaaaaaaagtgtccttccttgggctgcttctggagattctgctctcctcttctgctctcggctgttccgctgatgaagcttcacctcctttccgtgtggacagccggtaccttgcccttgagacagagtgaagtttgagatcgtgtttatagtatggccagttgttttcttgttcttatattttagataccaaacaagtgttaagcttcctctgttaggtggcctccactctttggtggagtgcagatgagttctgttggcaactttatctgcttccagggcaaggaaaaacctagttggccacccatttcttggaaagttaaacaaatctatttgattcagaggtgaaggtcagagctgtcaagatattaacataaaagatgcaaagcagctttttgttgactagccttgtattgtccccagttctctttaccctgcttttgccatcccctagccggtaaaaacataaaaagcaatttattctaagaagtactccaaagtgtcagctttgacctttgtcaacttttgacatgtgaatgctttagattttcttcagagaatggcttgtgggatctgagttcaacccactcatacagtgcaaaattgagagtttgggaatccatctgtgtgtaaatcacttcactctgtattcactagagtcaaacccaggaaccaacatgccgtttattccaaccttccttttcctttatgtgtgctgagtgttttagagtcgatacccagttagcctaaatgtccactagatggatgcttgggtgatatctgcaattgtggatgagtgctatgtttcactgacattggatatttgttctgatgcttcctgtggagaggctgtaggaggctaaatggatggcacactttttctttgtttgaggaaggccttaaaggatcaagagaatctcggcccactcccgaaagcactttacagtgctttgggacccttctgcttcatccagttgtctcatgggtattctgaaggcttgctcagctggattttcccaggctatgacttgattgattctttctggcaggaagctgctgcatctgacatgaaagcgtcctcccctccttttgctgtaaagcctggggagctgagaagagtgactcatcttccttcggccacactgaggaacaacactccaagtacacggaattcagagaggctgtgatgtatttcagttgatagagtgttttgctaacatgcatgaaaccctgggtttggtccctagctctacataaaactggacatggtgccgggcatagtggtacatgtctttaatctcagcactcaggaggcggagtcaggtagatctctgtgagttcaaggctgacctagtctacatagtgagttccaggccagccaaggctgcatagtgagcccctgtctcaaacaaacaaataaaactggatatagggtacatgcccataaccccaacacttggaagggagaggcaggaggatcagaagttcaaagttatccttggctttgagacgatctcaaacaattaaacaaataaatggaattcagaaaatcaggagatagcatgtctcctgggaaacagaagtgggaactggtttcaaaagatgttaggtaagcagatggaagggagtagtgtctggagtgttggagtgtggtcattccatcagctcctacctgtagtatattcactgtaccataggaatgagcgcctgggacctgggaggcagcccacactaacaagcagctgcctgggcaacaggcatcatttcaaaccttccttgcactttgaactcaggtgcctttaagccatacttgggcctcaggtgaattctgaatccaaaccacctgaggacataggataaaataaccacagactcattttctcctgttcacatgctcaaaaaccaacagaagacttgagtgacagatgtgggtgctggtctctgcaaataccaagcatgcttacaattcgaaagcagatgccaactgggtatcctttaactcagacagtgccaggttccacattaagggcatgtccagatgtcatacctacatctcagagtgttttgcccggcttctaaccatccattgatgagttgggattttcacaaccctctcctcagaactcaggggtgttattaaggtatattgcagtttatcatacaggatactggtgggcagactatgaagagatgcctggggcaaggcttaggggcagaggggacacagctaccgtctgggaatctccatgtgatcagctggacagttctctgcaccctgccttgggagctttcaatacatcagaatgagtgattaactaattggccagctcctcctttagcctcccttccctggaggatggagggcatagtgccaaagaattcaacaaatagactcctgccttggttcttccctgaccagctagcactgagaccagaggtttatgtaggtatccaatgtaggttttacaacctcactatcaggttttgagcaggaagaggagcaagaattcaaaagagaggtacggggctggacagatagctcagaggttaagagcactggctgctcttccagagatcttgagttcaattcccagcaaccacatggtggctcacaaccatctgtaatgagatctggtgtcctctgctggtataaatgtatgcatgtagatagagcactgtatacacagaataaataaataaataaatctttttaaaaaattaaaaaaaaaaagagtggtactcagccgagttgtcttcaggcaatagacttactaatgttgaagctgttagtataacagggtctgaaataagaatcttcaatgttgcttggcagtggtggtgcacgcctttaatccaagcacttgggaggcagaggcagctggatctctctgagtctaaggccagccaaagcaaggtgtctactctttgtgtgtgtgtatatgtggtgtttgtttatttgttgagacagggacccctgtgtagccctgactggcctggaactcactatatggaccttcaactcacagagatccttctgcctccgcctccaggtgtaaaggtgtcactcatcacttgacaaggcatcttctcttagaggtttctgagataatcaagatcttgcatttggggaagcaggctgagttaatgtgacttatgtcacgtggtagaaatagggacgaggtccagatgtgacttaggctatgacaggagtcactctttctctgggtagcagtgtggggcttggttaacatgtgacccatgtcaagctgcctttgactcccaggcagcagggagttgtatgcatttccatcctgctagaggccctctctgattagggcctattagtctgtattctccaataatcatatcacccatcagcatatcactccttttggcgtctgctaggcacaatgattagtcacaatttaatctggacatagagatactgctcaagagaccacaaataattttaatgttgttaaagaaaaaaattaagtttttacttaaatggtaagaaagagtttatccaatagtatttcagtctggacccgatgactaaggcctataattctagatattccagaaggtaagataagaggttcacaagttcaaggtcagcctgggctacagattgagttcaagtactgcctaggcaactaagtaaaaccctgtcctaaaataagaaaaaaaaaaaaaaagagatctggggaatgttatgtggtaatagagtgcttgcctggtgtatccccagtactaacaaaaaaagtactgctatagaagactctgaacacagcaaaggcaattgaagagagcagagtaaggatgatgatgagatgggtaggggaaaaaaaggcttagagcagtggttctcaaccggtgggtcacgcccctttggaggtcaagtgaccctttcaccagggtcaactaaggccatcagaaaacagatatttgtattactattcataaaagtagcaaaattatggttatgaagtagcaacaaaaataattttatgtttgggggaccatcacaacataaagaactgtattaaaggatcacagtgttgagaaccactgccttaatggaaacaccaattataaggggattcatgtgatcataatggagtatttgctacaggcaggtcaaaggggcttaggaacttagatattggacagtgaaagttgctaaattgacttagcaggactgttgctaaaactggaccagagggcaagatcaaagcctagctgagaatggtttcagaggaacctaactgaagtttgatcagggagaaagtcttgttttccttcccactctactgtaccagctcagctacaaaagagggagaggtctctgcttccttcagccaaccccttcctttttccctttttcccagactctctccttgtgaagagtgagaattggcagactccaaatttggcctctcaataggcagacttatttctgactcagtctagccagggaagcttgcttcccagaagcagagccccatccctgacagccccactggcagccttagtcaacaaaaatggaactagagttaatttgctggcttctcttcagtcatctactgtgtgaatggagctgaaggaatcctaaatccaggccttaggaccagaacagctgttccggttttgttttgttttaatttcttccataacaagttagacttggccaggacagcaaactacagtccatggaggtttttggttgttcttgttcttgtctttgagacagtgtcatgcagccaaggatggctttgaactatatacagccttcacatgctgaatcctgggattacagagggttctttggcagcttgctttgttttgttgtgggagactgttctttgttcatatgtcttatttgagactgtagctcataatggcttcaaacttgtgagcctcttgccttgcctcccaggtgctggaattgcatgcaggtgtgcaacattaagagtcaagggaatagctttgaggagtttggcatatcccaccaaaagaaagcaccaagtgaactcaaagaaaataacaagatcttataggtgatgtgaattttccttcaggaacagtggcaaactagttgggtgtggtgcttgcaaccccagcactcaggaagggaaacaagaagatcaagagttcaaccctagttgctaaggaatgattttgaggccagcctgagatacatgagacactcaaaaaatcaaaaacacctgggcataggcctttagttctagcactcaggaggcagaggcaggcagatctctgtgagtttgaggtctacggaggtctacagagtgagttccaggacagccagagctacacagggaaaccctgtcttgaaaaacgaagaaacaaacaaaaataaaaaacaaacaaaacccacaaaaacaatgagaagtctaaaggtttgtaagcagaaagtaatatgatttgaactgtttcaggaaaaaaaaaacccactatatgaatggacaggacaagacagaatggagggtggttgaagtggcattcatttgcccaagcaacagcaagggtggctcaacctagggtagttgtaagtttttggttagtggctcagcagcaccttctaggattgggctaaccaatgacagcaaatccacaagctcagaggttgacaaattcttcatgcttagtgggccttgactttctaatgttccccatcagtcatggcttaggctggttttaaaactccctcagcatactgggctcagtgctttgagctgcctctctgcagacccactctaaaggagttagtcttgaaaagtgagcaaaatttacagccagggcttctcctttttgtcagtcctttcttcctttaaatgttcctctcccaacctctgcagaatttgtcctcctgacaccatttcctcagaatgctgctcttgggaaaaggggaaagtaatcaagtgacacaaattgctaccagcttaaccgtgtctgaggtcatttgttctattactttagtgacctctaagacatgatgtggtaactgcgtaaataaaggtggctattttgaggtgggatggatggcctgaaattccattttactctggggacatagctcagtgggagggtgttgtctggtgaggactttatctagaatgaacttggactactgtagcttgactcacaaagtagcaggattcaaaccacatacttgggcctggtattccactgggatctcagggaagatcttaattttttcctgtcagctctagcccagaggtgggctagaggacttgaggaggctccccaggggaaaggtagaactgagaaatagagacagaatagccatgacatcctagacaagttaaagagagtctcattggtaaactggaagctactaaagcagaattgcagagctctgcccccagcttgtccctactgcccagcaatgattgtagagtgtaaccttacaataaaacattacctcacatctgacaacttattctaaccaatgctgactgatctcgattttttttctcccctccacaatttcttctctacctgggcaggctggagcccacttaagggtaagcaacatgaaatcacaatcccttgccttacaggtagggtaagcatgcttcattttgctttggttacatcatcttttcatttgttgtgttctccaatccacagatgctaattaacttcacactgaatcatctttgtcttccacactggatagtttctaattctttcaagcttattcatctgtatttgcaatgattatctcaggtctttcccttgtgataatactgcatagttcttcaggagtgtatgatctctgtagctttaaattattagtgtcataatggttcaatttaggctctcgtgtgtgtgtgtgtgtgtgtgtgtgtgtgtgtgtgtgtgtgtgtgtgtgtgtgtacacgtgggtgcacatgtgtgccggtacatgtggaggctagaagtcaatgtctggtttcttcctctatcattgtctaccttaatttttttttctttaagacaggctttctcactgaatccagagctctctgattccactagactaactggctagcaagcccaagggatccagctatctttatctccccagcactgagattacaggcacaggctgggtgtggggctccaaactcaaggcctcacatttgcacatcaggcactttaccactgagccatctccccagaccacaagacagagtctccttattcagctctgacactgctgtatagcctaggctgacctcaaagtcaaatcaatcctctaaccaacacaacacagcccttgctgggatcacaggcttgactcatcactcctggtttatatgatgctttttcttgtataactattaagttgcctctgaagatatgtctgaaatccaaagatattttaagcaacttgcaacattacagcaaatttatggcctctcaagctttatagcttagggggaaagcactcaacttgactgtcacaattttggtttcatcagctacaaattatgttatttctacaattaaaaaccccatgatttaggccacacctcgtttgttttttttttttttctttttaagcaaaagcactgctatttttaccagagtagtctgcaaatcattatctaggtccaaaaatcgggtttattgtcagagagggcaaacccttgtcctcaaagggaaggcaccatgtatgatgaaatcctctgagaaacggaagtaccgttagcccattgtgcagtgtctgtgaccactctgatgacaaagatctttctgcattacaagctgttcagagtaagtcataaacatgcactttggctgcaccatggatgggggtggaggtgtctcattggcacacttagaggcccaagttaaacataaactagtttttggaagagactggagctacagaataaaatttaaaatacacatttaaccgcatgcaactaattaaaaatattttctgatagttagattttatatgtagtctaaactttgttaggctaaatctttataattctatgcagcatgggctaactgaaagcttcggagcattatgccaagtattcatgatgcagatttagtttatcctaacaatccacactcaccggtcctgatgtgcatctcattagaacccaaccctgcactcatctgaagtctgatacattaatgagaaatattactggtgcataatagcacaagtcacctttctaagatcacatctgccttatttatttttgtttatttttgtgtgtgtggtgccagaggttggtattagttgtctttttctactgctgtctgtgttatcattactgttggtgaagatagttttgttttgttttgttttgtttgacagggtctcatgtgtagcgctggctggcctgggactcactaagtagacaggctgacctcagactcacagatctacctccttctgcctcccaagtgctgaaattgcaggtgtttcctactacatgcagattctaccttagtggttctcacttcacctggtgcttgccatctgtctggaccccaatgcttcacctcaggcttacaggcaggctcccccaggtcttaagggggtgatgaggactgaacctcaggtcctcatgcttgcagagcaagcactttacccactccccagctccttgcttatttatgtttagatgtcattttattattattactgggtgagctgtctgtgccacagcacaagtatggaggtcaatttctctttggtgtcagttctctcctcccacttttatgtaaactctggggatcaagttctggcctctagacttgcaaaataagctcctttatccaggtcctctttatttattttttgagacagggtgtcatgtatcctagactggctttgaactcaaaatgtttcagagaaagatctagaccttctaatcctcctgcctccacatcctgagtgctgatattataagtgtgcacatttgtgcagtgggaggtggggaaatccaagctgtttgttaggcaagcactctcctaactaagttacacctccccacacacatctgccttttagtgtgtgttgggcaggggttgagcacatgtgtatgcttgcatggcagtggcttgtacagggacacaagttacaacatatgtacctttcgaccctgtttaagacagggcttctcaccacggagtatgctaggctagctggcctgggagcgtctggggattctcctgcctcccatctctccacagtggtaggctaggatcacagacacttatgtttctgtgtctcactttcacatgatttctggagacccaaactcagtttgtcaggctttcatgacaagtgcttttatccactggcccacatccccagcactgcatctgcttgtttgtttgttttgttttttgttttggggggacagggtttctctgtgtaacagccctggctatcctgaaacttgatctgtagttcaggctggccttgaactcacagagatccacctgcctctgcctcccaagtgctgagattagaggcattcaccaccaccgggttatcacatctgctttttaattagtaagggtcatcaatatctttacccaaaacatcaattaattatgccataatttaatacatacccatagaacgaatatgatgctcttaactaagtatgagaccctgtctcaaaaaaagggagtaaaaaaacaagtttaaaagaaaaaagtgggaagaatggctttcatacaggggccaggaagcagctaagcttgactggaatgtatacttctgcatactcactcagtttcagtgaatgtatgggtgggtgcacgtaaaaaatgaacagaggccgggtggtggtggtgcacgcttttagtcccagcacttgggaggcagaggcaggcggatctttgtgagttcgaggccaacctggtctataagagttagttccagaacagcctccaaatccagagaaaccttgtcaaaaaaaaaaaaatgaacacaggaaggctaaggctagaaagatggccccaagtcctgaagcaatgtcctaattgttttccttcctcttattctcttttccttccattcccacagcctccagagcgatttttctacattgcagatctgattaaagtcctttttctcatccacactcttcagtcattttcagttgaagatattgctcaaactgcttagcatcatttgcaagtctcatcctcttgtgtctacctgccatctcagcaaacctgtagcttctcaaatgcagcatcctctctgccttagatttccctcaccccatatatctcttaacagttccataatttacttctctcatccagatagccaattgtcttgtcattactttacaaatttattgttctttgtctgaagaatataaaagcaccatgctttgggcatttcttcagacttcattctcttgtgaacatccccatatacatgtaaatttaataaaactttatgcttttgctcttattaatcagtttttatactaattgggttcctagatccagccaaagagcccacataagaactaagagggggtcgagagaacctctttcccctctacattcatataattggtaagtgatggagtcacgtatgtctgaccacagatccaacatcctttcagcttcactgtcctacctactttatacaaagaactgtgtctaactgatgagaatagcccctgtgaacaattaaagaacaatgaagtactgaacaatgtccgtggtattgaagagcaaaggggggttcaaaaagggagagcatattatttgggctgcctggctggaagaaaaacgtgcttagaaccagcctttgaacaggccctggaggaagggtgagacagaaccaggagtagtggagaggatgatatgagagataagcaagatgctacataagcaagagaaacatggcagggggtgggggtgtgtgtggatggagtcagtatgaagcttgttccgttggtggtgagtctttggagcctttaatcccagcactcaggggcaagggcaggtgcatctctgagttcgaggacagccagggatgcacagagaagccccgactcaaggaagaaagaaggtggagggcggggggaagaaagtgaggctggggtaaaagacaaggggggatgcttgaagggcgcagaaagtaaaacttggtgagaaaaatagaaagatcagggagagagagagagagaaagagagagagagggataccaagattctttcctagggaaggtggtccctggaggaaggcctacaagagagtcaagttctgcacacacttgccatattgaaagccacctctgcactgtgagtgagggaagctgaagccaggagagaggttttctgctagtgtagatgattctgctcaatgtcctacctggagagggtattcagggagggaaagaaagagccacatgtctgctcagccagtctcccatgctatctctttctgtcagtcttctgctatgtaagctgtggtcatggcattcaaagaaaaggaatgttttttcaagtatgggccctggaggctgcctaatatagactatcttattctgctgaagattgaggggggtatcagaggaaagacaggaagagatggggaagggagaagaaaatatcagccattatttgccatgttggagaaaatttgaactctgacttttgtttttacttgaagtctggctttaggtctaaaccacttgtaagagaaagccctattgcagaggacagggaagcacttttgagggtgccttggggtaaaagctgggtatggtggctcatatctgtaatcccagcacttgggtgttcgtatgcttactacaagctcaaggtcagcctggacaacattgtgagttccaggtcagcagggactacacagtgaaagcttgtttgagaaaaagaaaatccaaaaccaaaacaaataacaaccctacacacacacacaagacttgggttgagaagaaaactcaactcctactagcttaaaacaagggaaacattagtttatatggaagtccaggtataaaatggtcctcagatgagacataatctagtggcttctgtgttaccaatttgtttgtttgcttgtttattttttagccaggggatgtggttttagtaacaacccagactgagcctgaacatactatgtagccaaggatgaccctggatttctcattctcctgattgctaagattatgtagttgcatactactacccccggtttatgtagtggctaggaattgaacccagggctttgtgtgtgctaggcaagcgctctgccaacagagctacatagccccgttttacatattctgtcacttgttttgaagagttagcctgcatatgggtgcaaaccactgatatagtccattcctgtcactttaccagaagagaaattgaagcctgtcaaaaagagcaattttgcccagagttgtacatctcctttaatgctgagccaaccctaaaaacacagtggttgggccagtgcccgctctcaactaactaggctttgtgaaagcaatttggtggtgagtttatgacaggcagttcccggtgatgaaaaggaagacttgcggtgatcagaactggcataccggtgggtggatttctaaaggtcaggaccatcccctacaacttcacgaagatcggaaggggtggaggccagttgattgggtcttctcctgcaatgtaacacacatgcagaaagcctggtgtcaaccatgttagtgtctctatgctgcattagaacaccatgaccaaaagcaacttggcgaggaaagggtttattccaggttacaactttcaggtcatagtccatcaccagaggaagtcaggcaggcacctggaggcaggaactcgatcagatggcatggaggaatatctcttactgtctttctcttcatggcttactcagcgtgctttcttacagcacccaagacgatcaacccaggggtggtgctgccccctcgtgagctgggccctcccacatcaatcatcaatcaagaaatcgcaccacaggctgcccacaggccagtctggtgtgggcagtttctcaactgaagttccctcttcccaaatgactctgacttgtgtcacattgatataaaactagccagcacaccaactaaattgagagtggagaggaggaggctggagctggccagacagctgcacagggagccagcagtgggtaggatcaggatgagcaaactgttattctcttctctctcacagcacttgtgtattgggtggagggaaccttggaaatgcagacctaggcttttccaaaacaagagagggaaacggggcagttgggtagggaggggtggggatcccatagtgacagaaggcattcaagggaagaaacttgctaaaaatccatcagccccttcaaactccaactagcaaattaagaaatccatttagcttatgttgccataccctgacacagtctgatctgtgtttgttccctctagattagcagggaatctggtatgagatgatggccacttgccctcaggaggctttgtcccttatccctctcactgagccgtaacatgtactctctttaccttagtaagacttctgccactgtgaggcactcctgggggggggcactttcaacagctctgcccaggcctaaggtctcctgggaccactgcttatacaggaacaagaaaagaaatggaaagagtcagtactccgccctctggacagcacaaaccaacacaatgcattcttgctctctttgcttcaacctccctccctttctcgtcttctctcttctccccatctctccttttctgtcatctccctatatcaacacccctgccctcagtttttctagacatccggccctgctaagacacttgtgtggccgagtcagccagccagcccaaaggcacatcctcctcctaccaccatcttctctctgaactcaccacggaccgccttctctgtccaatttaggcttctcaggatggatgtcactcgcctactcctggccaccctagtgggcttcttatgcttccttgccatctacagccacatggtacctgaggagacactcagagatgacaggagtctgaggagcaactcctccatgaactcattggatttctcttctgtttctatcgtgggtaagtagcctggcctgggacctagcctctaggctgtgacccatgagagcaggtacagtatgtcaagcctgttgcccaggctgccaccagcatagctatggctctttcttgctcattcctagggaaatacagagtccttgagtcattgggtttgggaaagcttggcatgccaccaagttttggtgtgtcatagatctgaagaagcctcaagtcgagaagatgcttggtgggcttagtttaacttagcatttataaacttaatgaatcacaaaactcaacaaaacaaactttaggaaaaccatggaatagaactaagtctacaataaaccagtctcaccataggatgcatcaaagtctggcattggggatcttgtggtttgttctcactttggaccagggatgaagcacaaagtcagagcggatgcttagcaggcataatgcccggatccagttcctggaaccaaaataaaaataaacgcgcaaaggtttgttctgtgaggtggctcttgagttttatttttatcttacaacagacaaaactggagcttactgacattagttcctaatgggctgaaccagaattcaaacagcagccaattatacatgtaagctcacaactctgtgttgactggcatttcaatggacacagaaagatggtctagagcagcagttctcaaacttcctaatgttgcaacccttattaatacacttcttcatgttgtggtaaccccaaccataaaattatctgtgttgctacttcataactgtcattttgctactgttatgaattgtaaagaaaatattttttgagatagaggtttgccaaaatggttacaacccagaggttgagaactattggtctatacatatcagagaagtcaaaggagggaaaggaggagacaccaacattccttaatcaccattgatatctcagactttttaaaatattttacttttatgtaaaggggtgttctgccttcatgtatgtctattctctgtgtgcagtcctggtaccctcagaggccagaagaggatgccagagcccctgaaactggagttaccatgtgggtgctggggcacaaacctgggtcctctgcaagagcaccaagtgctctcaacagctgagccatctctccagccccatgtcagactttttgttttataaatatactttacatgatagaaccttttgtaaatgagggaactgattgtccaggagaagatcacacagctgttatatggattcaagtcaggcatagctggccctgagctgaaaattaaagaaaaaaaaaagtaacacagatgtgtccagtaacaaaaggccaagttcatttccagagactcatagtgctcttgcacctgcacggttaaaggctaaaacaggggcacctatggtgatcaagggccacacagtcaaaagaccaggaaggtctctgacagaggccacagacaggtccccggtccctcttggatttcctctttgccttccctcggagcaccctgctcttaggtctgatgccaggctaataagaacctgctggcttgatttccataatgtgttccatcctggagtccctttttctctccactctgagacttcccatagcccctgctcctcccacttcataactcaggcccccagaaacatctggctttgctcgttctgtctttctttgaagcactgaacaagaaatccaagaagatcaacagaaaagaagccgagaagcagaagagatcgtccaaggtaggcctgggggttctcacagtgagggtgggagatctgcaagccatggctgagaactaaatgtaagatatctccaagcctacatgaaatgactgaaaactacctaaaggtttctggcctagagccttgaggcagacttccatagaagccagggagcctaagttcactgaacaaaacagctacctgattaaaaaaaaaaaaaaaagtttccaatgcaagcatccccaccccttcctgaaagctggcactcaatcttttggatatttacctaaaccccaactgctgcagaaccactcttgctatacctgagtttcttccctgcccccctttgtagggcctgtgcaaggtaggcaagtgttccaccgctgagccatactctcagcccaagattatttgcagcaagcttttgctatgtagtacaggctgcctgtgaactaccaaccctccttatccagagctcaagtgccgagattacaggtccaggctaccgtgcccagctgtctcacctgtctgacaatcagaaaacgtcaagaataggaattagaagttgggggtggtggcacacagctatactcccagtatttgggaggtggaagcagtaaggtcaggagttcacagccaccccaaactacatgccaagttctgaatgaccctgggctgcacaaccactgtagctagagtaaaaacctcaatgaaaataaaacactggtagcagagcctagcagcacaggcttttaatcccagctgcttaggagactgagagaggaccctcagttcaagggctactggagctatgcagcaaattcaaggtctgcctgggcaaactgaaacagtcacaaaaataaacatttcaaaggggtggggatatagtgaagtagtgaagcttgcctgtaacaaacaaagccctgagttcaattcccatcagctggatgttattacctgctaaaggctctaaatctcgcttttttaaaaggcagttagacctaaagtacatgtgccataccagaccaaaattagagttagaattataactggtaattgttactttcaacaagcagtctagataagtctagcaagtcagacagaaaatgcttgaagagacaagcaatttggagaacactgttctacagaccccaaaatggtctactttcttgtattacatatatatatatgtatatatatattcttaaacattgggcttgtttactaacaaatgcattcattaaatatatttactaagtatttaaaataaggacaaaaaagcagtgaccgctctccccgcccccccacaaaaagaatgtgttggaaagcaattaaggacatgtcatcaccaaacacaagctaaaacagaaaaaagaatgccttctcactaagtggttaaggatcatttaacgttttcttacctcccacctaagatcatactgccatgatacaggttcccacaatttgataaataccagattgaagcattgttgaaattcacacactattcctgtttttgtgcctcagctaaatggatcaaccgtaaccagaacagggaggacagaacaaaatacatgtatgtgctaggtgctgggaacacagcagtgaacaagaggttactgatgtgtggagcttacacctgtgtgggaaaaccaggccgcaagtaaattaataaacaagtttaaatttttagatgacacacattgtgaagaaattaaagcacggtgaaggcctaagtgcatttaaatgaaaaatatagaaatctagagtagcggttctcaacatggtatttccattatgattcataaaagtagcaaaattacagtggggtctcttaagaaaaggccaggtcggatctaggtgagcttgtagatgaaggcggcgtgcagggtggggtggcggccagggacccactaggatggcctgtgcgttatgagtagaggtgggcaccgcggcagaggtcctggtggcagacctccacagcagaagaggacgcgcgggaccagcgtggcccgctcagcagccctcgacgtctttcctacagaaaaaggcctcgacgaagaaggtggcacggcccccgccacccacgccctgcgtggccacccgagacagctgcaagccgcctgcacccgcctgctgcgacccgtgcgcctcctgccagtgtcgcttcttccgcagcgcctgcacctgccgcgcgctcaaccccaactgctgaacgcacttccgcgctgcgcgcgcagcctccgagatgggtgattgggcggggcttcaaggctgagggaggggtctcttcgtgggtgggcgtggtctagggtggtgggtgctttccgatgacaggtgttcaaggaaccctaatggaagctaaaatcagaatacagtatctttcggctgctgggaaagtgtggctgtttctttaaaagagccgaaagcttccggcccctttaccgagctctgatccttgcggagaccccgaggatcgcgcgtggctggtacctttgcttctagcagtaggcacgatgctgcccggttccttccagactttcagtaccggctgcctccagtctaggagaaagggagctttagggaacggccttccagtattttcaacgctctcctcccggggaggagtacaaatatcccaggcgagctagaaatccacaggcagtctcagccgggtaggggcggggtggtgcatttgttgtgggtttctaaagccagaaggatctgggttgaggatcctagaacttttaagagtctcccaaacaaaggcactaatgaaacccactcctcccttcctcccaagggcatacagatgtttggaccataagaattttccgggcattagtccccatgcatttaaaattattattctaataccctagagtttgggctcctaaagaagcaaaaatgtacacagccttccttgatcttcacctagttggccggtaagaaagctgtaggggttggggggagctggaaagaagcggcaatcgcactaagttatcaaggacctattgccaaaaacgtcccagactgttccctgaaattccacagagtctcagtttgtgagaagctgaggtgctgcgttgtaactttggaagaaccgtgggagagagagcacctagagaaagtgaagagtttgtggcgcagattctgtgaggaaggagcagcagggagagcgcaaatggagggttctagatagtgccatctacttgtcttggctggggcaccgaagggagaaaggctgagaagagggctcacagggctccctcgcctagcctgagctgcccccaaccccaaattattacatgcaagtaccaaaagaaaaagggctttgccaaaaaagattccatagagaatctctattgggctagggagatgaagacaggtgtaaggtctgatacaggtgtgaccagcttttcgggcctttgtgtctatttgctattgttctctttcaaatgctggcaagatggctcacaagcctgccaatctgagttcaatccccaggaccttgtaaaggtaagagaaaacagagccctcagagttgtctgtcacagtacacaggcatcctcaaactcacatcacatacaataagtgtaataaatgtaaatttcactccctcaaacctctcttcttgccgtagacctttttccaaatggagacccaggttgtgcttttggtgccatacttacctcgaatggatacaagaggcaaacacctctgcccagtcaccacctagacagggcacaagaaaaggcaggtgctccaggcaaagctattcacacagtgctgacactggacaagtccttatgtctgtctctcttacttatctttaaaatgagaaataattccagctgttcttggtaaaaatccaggaagttgtgatttctcaatgcctttaatgcagcaccaccacacacccacacgcatgctcacccacacccatgctcgcccacatgcactctcacccacatccatgctcacccacatgcatgctcacccacacccatgctcaccatatgcacgctcacccacacccatgctcatccacacgaatgctcacccacctgcacgctcaccacaggcacgctcacccacatgtacactaacccacacccatgcttgcccacatgcactcttcacccacacccatgctcgcccacatgcacactcacccacacgcatgctcacagagaagctgcccattgtttgctttgttctctgtcctttaggctgcaagcccacaaggcaagaacatgttgttcttgtaccacagctgctgctgagtaaatgtcatcagtaatgagaatattgggaacacattgcagcaactgctcctgtatttgccagacactgttcactcaccaggtactatttggcgcccagcagtgaagcagcataaaaaactgaacactcagccagtttgttgttgttgctatgtgccggtttgtttttgatattgtttttgagacaaaacatcactatgtgtagctctggctggccatggactcatagaggtccccctggctctgcctcccactgctggaaactaaagaagtgctaccacccctgcagcccactagcacaaagccattgagttactggatttagacaatgccatggaaggcaagcccaggggttcactcattcagcttgtgtgttggccacctgctgtatactgggtactgtaagtactctaatgaaaaactccaatatgggtattgtccctacagaccttaatcattcagtgggcctgaccactggccctcataagaggcaagaacaactgttagcctgtggggctcttcctcacacttaatcttgcttctgttgactcagaccccctagttaggtactacctgcccaggttttccttcagctttgagatcctgagttgttctatcttttcagaattcctctgtaagctttagagtcctaagatcatagcccactttggtggccagaactaaaactcacgtttatattgtatgttctgttatgaggatatgagtgccttagcccatccccacactattacacacacacacacacacacacacactctctctctctctctctctctctctctctgggtaaactttgtcctgtaaaggtttgctccgctattcatcctttcttcccacagccattgccttaaacttgtgcacccgaagttctcataatgtgaccttgaacacgtctcaagtttgtttgttttttttttctgtcatgggggagggggtggtctcatgtaactcaggctggcccaatctgcactaacttcgaacttctgatcctcctgcctctatgttctaagtgctagatgacatggatgcagaaccatgtgtggtttatgatatagtaggcgaagctgggatccaccccagggcttggtgtttgctaaatgaactctaccaaccctcctacctcctcagctctggaagttgaagtcctaagtgagaatctcatcatacagtacacatgaaagcatctttgtcaatatgttatatttatgcacacaaaattgaaatcagcgagtagataacaggtgccctccctaattagccccaccagccagtttgtctgttagtttggttttagaagaaagtttaaatgaccaggagatgtaagaaggtttttaacagctcaccctttacctcatacagcctcctaataaatggaaacagcagggtttatgtcagaatttggtccaggtggttttgcaacaggttaacctttaatgcatagaagatttaaacatgtatgtttttattacatctttttaaaaagctttgatatttttaaaagaaactaaagcttatgatttcacaaaagcagtatacttcaaaaactctgtagtctcagaggcagaaagccccagggccccagatgtcccagactgtggacgtaaggtcaatctaactggcaatcactaggtcctgattctaaattcttccatctgtttcagcgagcacagatgtggaccactacccactgacaggaaattacccttctccaaaaggagctttataaagaaacctagctcccggggccaattcccatgtgtggagggaacaggataagtgaagaataagaaagtgatttgagccaaattagccaaaccatctgtagtaactttcagatctagagtagacttttactctttttcttcttccatgaactaaagggatagacatgtgtgttgaaagagaaggcagctgaaaaggaatttctttgttattgttttatcaagtaaaatatttcaaaatagtaaaaggctgtattccagaggggagttttctcctgatagcctggagaaaaacagtaactacttgccaactcccccagccagatctgtgagttgtatctgggaggtggctccagtggtggtaataatgcttatgcttggccttcttcttgtcgggggagcccttctcaatgagtcttaaaggttttcacaccttccaaactcctccttagaattcctatgcccagtggctgtgtagactactggagcaacagtaaattacagctactttttaagcccatactcagcttccgaagcaagttcatggctcgctgctcactgcaccagatttctagcaaaatccctaccgccttgtgtttgcatctggaccaacctgaatcacgtacttattcttaaaccaatttgcagagttgattgatgaattgattgaagttagttggctaagcctggattacatgagcaccctgattgcctcaagcaggtctcctggaacagtgctgagtctctggggtgagaatctggcttcctgggacttcagaccaccaaagcagagctaagtactcactgcctgctgcccccagagttttcactgctattagtgggccctgtgacttttcctgggttttaacgcatgcttcctccagccctctaagctctcattactattcagctaagacttgggagtctccccccaacagcctgacacctggcggcaggaagtacccagccctgcaaggggacttcagataaatagctgaagctctggggaacaatcactccatgtctgaacactgacttctactttagtaatgctctaagatatttaaggttccagcagcctgtggttttataactgaacttgacacaaaggcagacaccacacactttaaacggggcatttttcagagccgacaatctaagaagatgttgggttaccatccctaaactctgccttccatctcatccttagccagcagattacactggaagggaaacacaggcagtcagtcactccagagttgagccttgccctctgctcagatggtcagtgtcttccaaagattatcgcccccactctgtaacaggggaggattttctttccctctttatggtatctgtgaacatgggagttggtatacaccaaggccattgaatcttgaagtcctcccccagaggctgtttggacaacatgtagatggaagattaactcctataagcaatgtgggcagaagagtccttactacagaatggagtaaggatgtgcttttctaaaatatgggaagtattgtttagatctcaaaagtcttctaaactccttaccctccaaacaactctctccccaacccctggccttaaaacttgacatagaactttaagacaacaatctgaggtatttgtcactatcctgagtgggactcaggtcttctccttaacccgcagatcactgccccacaaccccccaggcctcatcttgtttttttcaggctagatgggaagcacagtgggggccaggccagatactgtgggagcctcagctagttcttcctcatgaaactttggcaaagagctgtggagaaggcccgagacacatcatcctttattgtggatacctggtcattgtcacacctgtgatagagtagcacacctgagtacaaacctacacctgagaccagaagtgaaagttttgtttttaatgaaaaggttctgagagcaagagaacatctccaaaaaaaggaaggtaacggccagggtaacaaaagccaggttaggactgcatgggaccctcaccaggggacagcttagggctgcatgggactctcacagatggaacacctggaaaggcacttgctctatctttgtgctctatctatccaccctcagctggtctctttggagggatcagcatagccactgctatcaagggagcaacactcagaacagcagtctctgcaagtcagggtgggatgaagatggggtgaagcaacccccactgctggagccttgcttttaggaacctaagttccagtttgagttacttaacctaatgttaaggagtctgaaacctcgttccctccctcctaaccctgggcctatggtatagaaatgtcttggattttggttccaggaatccaacctagtacaacagctagctcatccaaatggcttctctcagcctgagtccaagactctagcaagttctcgtgaagaatgagtaagatcctaaaaagtgtccttttgagcaacaggatgcaatggggcacccctctgtaataccagcactccagaaattgaggcaagatttttataaatgtggggttcagcctgggccaaggccatctcaaaacaaaggctttttttggttcaaccttgaacacaattagtgtgcaagaaatagtacaagagatgtgtctcctattttttcaagaattaggattgctttttatttaatactttgtacttttactcattaattttgatcctatccatctatcattacctgttggagacagctctgacatagctcaagctgttctcaactccccctgtagccaaggatgaccttcaccttctgatcctcctccctcggctcccacagggcagggactgcacttccctttcagtctattttaccatttcatgattagttgagaagtggggggctggagagatggctcagccgttaaaggctaggctcacaaccaaaaatatgagaagtgggcccttggcatctgaatttaccaaaacttattttcagcaaagtcatcatatactcatgtagtttacacaccttcaactacatgtactgcagggagagaaagtaattacttaagggccaacgcctaagctgggatgaacattctcagtcccttatccctgtgacactggactgctgaatgacccaagggttttgtttgaaatctttaaaactttgaggaactgggaatggagatgaatgattggctgtgtaagcctgagacctgaatttgatccttagaaaacacatgaagatggaaggagagaaccaacccctaaaagttgtcatctgacatactgtattcacattacactggcaggaagatcagaaactgagtcacctttagctatatagtttgccagcctgggcaacttgagaccatgtctcaaaaacaaacaaacaaaaaaccctacttttctccaaagtcttttcaagcactacctcttctccaatgcctttctcctgctgccagacatggaatccaaaagctgggaagaaaaggggaaggggcaggggatggcagagctgttcctgagagaacctatctttacctagacatcccagccatctgtgttcagcgctcacacttacaccgggctctccattctggggagggcactcagaatgtcattctgtacatttgggttgcctttagttgacttcagggttaaacgggttcactaaatgaccacttggacaaataacagggagctcaatttctcatacgtttttgtatgactcaagttatgagatctctgactttacatttctgagggactccctgaagagatggctgagtgggtaagactactttacacttgtaaaaaagctaagcaaagccatgtcctactgtatccccagtactggtggacggggggtggggagagcagaaacagaacagcctggctccaggttcagtcagagaccctatctcaggaatacagaagagagtgatcacacacccaatgtcctcctccgggctccatgaccacagaacacatacctgcacacaaatgcacacataccacacacacttaaaaactggcatacatggtgatcgacatggtagtcaatatcttatataataaaaggtcaaaatttctttaggcaccagaaattttatttaatccaccttcctttgttaacattctagacactataaatcaaattagtctttttgtgacccaggcttgtcacaaaaccatcaattacaagacagtgacagaccttagcctatttgttttttctggtccctttcaatctctagctgtcacttttcctttcttggttatctcttaatctattctaaccccgtgaaacagggaccaaaagtgccaacctcagtattctgaggtttaagagacggcccaatggtaaataagctctgaggaagcccctccaaactccagtggctcctgccctgtcccgggctgagaaactaagcacatggatctaataaagcccaagtgagggtctggatggtaagatgcatgggcttgtgaccaccactagccacatccagcctcaggacttccaagactccgaagctcgtgtcccctgtggatcgctcccaggtacctcttatcttgactggagactctcagttcccctcaccacacctagaacagtatgaaggacacaacagagaccagccagagtaaccagcctcagcgggacgaacactggcgaagcaactgcaaagttggtgacatgtgctcttgggaaagagaggtagggcctggagtaaggatggcagctggaaggtgaaggacagtcctgtctctcagtagcggtagtgatcaggcttgaaggggccatcaatgggcatgcccagatactgggcctgcttctcagtcagcttggtcagcttcacattcagcttgcccaggtgggcttcagccactgcctcatccagctggagagaaacagaaacctggagttagtgtcatactctagtacccttagcctcatctacccaacagaactgctctggggaggaggggggttactggcaagtggtactaccctcagcacagagtgcttttacattcctaagcagttttatgttcactgtccttagaacttcacaaacattcctaagaagtaggaaggggaggacaatgcctacactaaagaaatgattatcaggttcatagatgcaagtaaaggcaagaagggcctaacctggaatctgtatcagaagcagaatgaaggtctcctatgcctggccaatctagctcaggacgcctgccttctcacggctctctgtaccagtgtgccacataatgggtgaccatctgggcagtacgagctggattcccagtgactcccaagagtacaccagcctctaaaccgtggtttcctcacttgtaggacacacataataaatatatcctatgtggccatcacaaagatcaatgacattcagatttttagttcaagggggtgatttatttagtcaatagtagctactatcatcattaattaaggtacctaatagtgcttagacagtatgcatcttacagacatgcctagttgacccacccaagtaccagggatgcagctaagggatattttgtgtagcatgtatgaagacctgggctccatgtccacaaaatgaacaaacaaaaatttcaagataagcatggagactcttgcctttaatcccagttctcgggaggcaggaacaggcagacctaggagtcaaggccagcctggtctacatactgagatccaggccaatccgggctataatgagaccctgtctcaaaaccaaacagatgaacaaacaaagtaaatgggcccatccattttttaaactacaatatgttgcttatattttaaaattatttcataccaagaccttagcatatggcttctcttcagagctcagaagctttgtccactggagctgtgtcctgggctggtgacagctgagtggcagccacccctttatctggagcatgtattcttcaacttttcacttcccaaccagcctactttaccaactacctcgccattattattcagaaacatattcttgccttcacctgacaactgaggaatggagacaaagctccaaacctggtgagccacacttcaaagcccatgccactatgggtgtgctctggaggattctggaggacaactaagacagtaggcaaacaacataccctgccaagcccacacagggagcccaggaatagcacaggagccttggcttgtgggaaagtcaagagcttaccttcttaggcaagaagtgaaccccaacggggtatttatctgggtgggtccacagctcaatctgggccatgacctggtttgtgaaggagttgctcatcacgaagctgggatggcccatggcacaacccaggttgaccagccggccttcagccagcaggatgatgcggcgcccattcttcagcctgtagcggtccacctgcaagtccccgtggcaacagtaagggctggtaggcaccacctgtctctgcccacctcctaccctgcacaagatagcctgaaatgcccccaaccctacagagctagcacacacaattaagagtagcaaattacctcaccagcctgttgtgagaacttaatgaattcagatctataaagcacttggaatacggtagtaggtcctcagaaggtagcagctagtactgtcattactgccacatagtgtgtacataatcctttacccacataagtatcattttttaaaatttattttgtgtgcattggtgttttgtcatgggtgttgcatcccctggaactggaattacagacagttgtgagttgccatgtgggtgctaggaattgaacccagatcctctggaagaacagtcaatgctcttaaccactgagccatctctctagcccctcatgactatcatttaagtgcttcagcatcaccttttcacaaataaactgaagtctacaaagctgagtcatttgttcagagctacatctaagaagtggctgcaatttgagccttgacaatttgaggccaggtctcatgctctcaattgccattaaaaagttgaatgcaggatggtgagatggctcagtgggtgaagttgttgctgccaaacctaaatttaatccccgggaaccatttggtggaaggagagaatcctctgtgacaggctgtcctcttacctccacatgcaagtatgtatgtacttagacatacgagcatgcaaaatgattaagtaaaatgtaattgtatgtgtgtgtgtgtgagtgagaaacagaaagagagagagagagagagagagagagagagagagagaggatacttatatataaggttggatgcaggactgaggacctgactagcttggtaacagtgcttgcctagcttacatgaagcactggatttaatctccagctgtacaaggcaaaaaagagctcttaatgtacaaagccaaaaccttttccaggaacattgcttttataaccaggtaagaaataaaaagccagcgcctttaatcccaacactcaggaggcagagacaggtggatctctgtgagttcgaggccagcctggtctacagagcaagttccaggacaggctccaaagcaatacagagaaaccctgtcatgaaaagccagataaaagttgcatgtactccaaaggaactatctctcaatgccctgcagcaaagccaccctttctctaactcaataatgatggcctactttgcccagagcaaagacagaaatgcagtgtccctttccagtcctcccccatcctgaccctgctgccagttcagcccacacacctcagctgccagcatgcctgcctggctatgagcaccctcagagccttgtctctttggccaccactgtatacaaagcaatcttcactcccaagtacatagtgacctgaagcagccaggtcaccacgctccacacacctgctgaccaactctgatacctcaaacctaactctgaaatgaggcttatccaacacacacagcactctccaggttacaaaagtttccatgagaggcatcctccccgcccttcaccaccatccctgcgggaaaggctggggcttctcacctggggcttgatgttcaccttctccacagcgttctcattgagccacttcacatcaatctccacgtcaaagtgtccaatgttacacacaatggcatcgtccttcatctgttcaaagtgcctatgagggagcccaaccccgtgagagaccagagaccaagaacagccccaagcctgtgcacctttgcacctttgctccctaggattcccacgtggtacctaccggccaagaatgatatcaacacagcctgtggtggtgacaaagatattgccctccttacaggcctcgtccatggtggtcacctcatagcctgcgcagacaccgagcatgagttatcaaaggtggcctcagtcctcctctagccccaacagccagaccttgagctatcataccctccatggcagcttgtagtgcattgatggggtcaatctcggtgatgatgactcgggccccaaaacccctcagggcctgggcacagcccttgcccacatcgccatagcctgccaccaccgccaccttgcccgcaatcatcacatctgtggctcgtttgatgccatctatgagggactcccggcagccatagaggttgtcaaacttgctctgaaaggagagggggtaaggggatgaggggcaggcaaagccttggcctcaaagcatcccacaggcctgagacttgagccctgtcagcctggctgaccccctaagaatcttctccactagacaatgccaacatgaccccctccccatcagcctcaagactgtctctctagcaggtctctgctgctctagaagcagcccagggaagcaatgcccaggacaggttactgggtcaaagaatgtgcttaactttaaagctcttgataatcaaagccacaatgttcccgaagcagccatgacccactgtgcaggtctcccttcaatgcactctccaccctcagcccctcaggtaagggcttcatgtcccaggccatacccttcctggacactcttcagagatccactcctcggctcactgggcagcaacaactggagctgacactaccccagggctcaccttggtgacagagtcgttgacattgatggcaggcaccttcagtatcccattggccatcatcttgtagaggttgtggaccccagtcgtggtctcctcagagatgcctcggatgcctgaacaagagagggagagcatcagagaacacatctctacccaaagcccttctcactcccaagtgtccccctctcctttattcccatctctgtacctgaccgtaaagtctaccaagtcaccaaggccagtatcatctgatgcctcccatataaagtcctaccaggcctaatgactcaacttcccaacaccttcctcccaccactgtgctagttagtgcctgacactattcttcatccagttgtcctataatactttcaagagatggcttcttcatttactagtcatgctagtttttgtatagtcaatctttttctacctcagggccttttgtattctccaccctccatcctcctcctccctgtcacacagtcaacaaggctgcttctctgcaaccattcctagcactgccctacattagccttggctaatgagctcagcaagctctggctctaccccgttaccctggcttcacagcacaagtcagaaggcagactccatgcctgcaggaacctcctgtcctccaggcctatggagaatctgggcgttctgccaggcccattgcctcaggtctatgaaggggcaggctcccttcaggccactagtgcccagcccagctgcttacctgacagaagctgtgggtacttggtatggatgaggttagttaagtcaccaccatcatccagaatcatgttgagaggtccatctttgaagtgcagcgtctgctcaatgcaccacaggtactcttcgtctgtctcgcccttccaggcatacactggagggtgagtggcacatgagaagctggcagggaggttccagaaacagagccaattctgtccccttcctaattcccatccctatgtatgtccagtctatagaaagcaatgggaagtatacagcttgaagctagacagatctaagctcaaaccctggctctgaactttccagccaagtgactttgagaaattcactttaccagtttcctcttctataaatgaggcttgcagtaatataaatcactgacacagaagccacacacagccctagacctatgtgtctagaaataattattcccttttgtatttccttcttccagggagtagggtactggactacaaaaaataggactctaacccagaagggcatccttctcactgggcactgtcaggtaggaccctggatttgttcactgaaaggtcttgaaggcctggcagtctcggtggtgggtaatttcaggtgatgcctggtcaaagttcccccagagaagctactaaagacggagcattctgtgtcaggtactgtaactgctctgtgcccatttgagtgccctcacaaaaaccccataaggaggcactgccatcaccactcacaaaaacctcaagagagtctaggaagtgcagcactcagcacagcactggagagcagcacctgaaacaggggtgctggctgctggccttggtcctcccaccgtgtggaacgccacaggtgtgggcttcaagactctcctgtttgcacaggacaccagccaagcagtcggctgcctccctccccacaactgtagaagataatgctgtcaaaagcaaagcctcttttgaaggagggctgccgagcctcactaaggtgggagctgctgacaggcactcagccctgtgaggctcgacaggagcccctcccaatgcccccgctacctatggctgattaagatctccccccaccagtcgggcgttggtggtgcacgcctttaatctcagcactcagaaggcagaggcaggcagatctctgtgagtttgaggtcagcctggtctccagagcgagggccaggataggctccaaagctacacagagaaaccctgtctcgaaaaacaaacaaacaaacaaacaaacaaaaagatctctcccaccacatgttgagtgttttgcctatgaatatgtctatgtatgatgtgcttgcctggtgtctgaggaggccagaaatggatattggatttcctgggtctggagttacaaatggttgtgagctgtcatgtgggtactaggaatcaaacctgggtcctctgaagagcaaccagtgttcttaaccactgagttatctctctagccccctggtaaaaattcttgtatattctatttaatcaccattgaacctaacaccccccaaccccaccactgagtccagacagacatgtaccactctgcagcagctgagacaaagtctttgctctttaactctggtcctttcacatactcctaaactaccacaacacctcagccagtgcatccctgagattccagctctgccttacactgcaccagtttgttctttagtaaatgatcaagagtccctctaaggagcttccctatcctctgcaccatggagctcccaatcttaagattcttccactagagaccacataactcagtgggtagataggtatcttccatgggatctgagatgaggtaggagggcaaaaaagctctttattgtaagtcaatgggataaggggctctgtctgcttatggaaacctatactacaagagtcagtaagagaaacacgaaaaagcaaagtgctttatccactcccacatagtccacagtgagcccactcacctggaatgcccgccttggcaatggcagctgctgcgtggtcctgagtagagaagatgttgcagctggaccaccgcacctagaaggaccaggaaaacaaggctgttggtcacgggtggctatgaagaaacagggaaaagaaagccctgaggccaagagtaaaaggctggtactctgggcaagtgaatagctagaagccaaagcagtaaaaagataccactagaactttaaaaaaaaaaaaaaaaaggcaataaatcactgagccaggcatggtggcatacctataatccaaaaactcaagatataaggcaggaagatcagagttcaaggccagcttgggctataggagaattcccggccagcccgagttatgcagtgagattctgactcaaaacacatacaaataaataaacaactagagagatggctcagcagttaagagcacttgctgctcttgtagaggaccctggttttggttcccagtatccacagtgtagcttacaaccagtaccttctcctgggctctgtgggcaccaggcatgtatgtggtacacatacaaacatgaaggcgcagacgaaaccctcacacacacaaaattaaataaataaaacgttactctagtgctatgtgaacaaggagacagggaaggatctgctaaagcaggctgcagagaagaaatacagcagcaacggtggaagtgatgtgtggctgtcaaatactccagggtcctcatgcagggagaatctccaggctagacttgccatttagtgatggatgtagcggacttcaggatgcagagggtagaaagtttgtttggacttgttcgacatgggatgtgtacttgatggccaagaggcttacatcaatacttagatgtgagaggcttgtacatgagtcatcaccacacaggcagtatttaaagccatgaaatcagatcaccaacaaactgaatgttgaaaataaaaagaatgggagctagagatacagtggttgagagcactggctactcttccaggacctgagttcaattcccagtcccacatggtggctcatgaccaactgtaactccagttgtagggaaaaatgacaacctcttctagcctgcttgggcactgcatacaagtggtgcacagatgtacattcaggcaaacatccatacacacaaaataaaaacaaatctaaaagaaaggtcaatggaagtaaaatcccagtacttggaaggctgaggtagaaagatagcttgagccttgcctgaacaatacagtaaattccaggacagcctaggctacagagtgggatgctagctcaaaagccaaagaggccctcaagtttctctgccacaggtgttagcagtgggaaatggagagaaaaccagctaggtctcccaaccagtcctcttccatggctgaacccagagagggcaagggactcaaaggagtcacacggctgtggacctcacctccgcacccagggccacgagagtctcaatgaggacagccgtctccacagtcatgtgcaggcagccagcaatgcgagcacccttcagcggcttggatgccgagtacatctcccgcatccgcatcaaacctggcatctcattttcagctatgtccaaggcctttcgtccccacgcagccagtccaatgtccgctgcaggaacaagatggagagagagttacacaagccacctcctcccatcaaccatgaagcaccatcccggtgtaaagagtgatccaagtgtggccctatagcccttaggctgagcaatctgccacagcattctgtgactcacaacaaagagaagcacaaatgcctcttggaaaaacagctgagactgaatcccactgtcaatcgttttcactggtgtaccaacctcaaacatcgatcccctgggaaaactcaaatccagcaagtgtagtaggatgggcctggggttcatggtgagatttgttttaactattattttttaaatgaaaggacagtggtctttctttttatgtatgtgcatgtatatagaggtcagaggccaatgtcagtgtctttctcaatttctgtcttattttttgagacaggatctcactgcacctgaagctcactgatctggctaggtagactcccctcctgcctttgcctcatcagtactgagattataggtccttgcagctttacatgaactcaggttctcatgtttataaagacaggcaaacttgccaattgaaccatctccccagtgtgtttacctttggggagcttaggtctcactcaccctaggaaatgaagggtgaaggagaaagaaggctgttacagaaatcttaataatttaacaaatagttaaacatgccaggagtggtgtaccatacctgtaattctggtacttgggagatagaggcaggaaagtcatccttgactacatagcaagttcaaggccaacctgggctacatgaagccctgtctcagacactactgctgctgctactactatgaagactttattattattctgcttcctacactgcattaaataatttcaaaggagcagtgacagggtgtgtccaagaccctgatctaccctaccaggggttcaatcagcaatatacacagctcctcatctctctctctctctctctctctctctctctctctctctctcctctctcctctctccaggttatcatctggcatgtcttccccctgtacattcccagctccaagagggaacagctcagactctacaccactgatttttatcaatttctagtgtcttttaccatgcccccttcagcatctccaattctttcgtccagtttaggatacctctgtccatcccctgctctcttagcctctgagacctcacttagcaaagctcatacccaaagcttgggtgggtggcttcatgcctgtaatcccagcactagggaagctgaggtaagaagaattgagttcatcctgagcttcacagagacctagtctcaaaaacaaaacaacagcaaaagccaaagtttcctcctagttagagccagctcttcaatgtagctaaggcctgaactggcaggagaatcaacaggcatgggacaacagtcttgcctactatcaacataaaactcaagggacacctggcacatcccagcaaccctactacattttcctaataagtttatccccttctcttctccccagtcatctttcctcatcgactgataacattacttgacaatttactttctgtccacggactccatcctcatctgtagttagactaggcattcttgtctgtcgaaaaggataagctgtccctggtccctgattttctcatcccttaccgttctattctgggtacccctggggtaattatgctcaggtttctcacaggagcagagacctcgctaacgactccatcatttctgaaatgtttgcttttccttggcatctgattctctcttctccctccttccttcctagctgctcttcatctgacacattctaagagcccttggggacccatcatcgctcctctccaaactcctgccaaataagttctattcagatgactgtgaacaccttccccatggtgataactcccaggtattgacctccagtacaaacttctcccaggaatttgagagtcacataatctaactgctgactcagcaactctagactggtgtccaactgtttacccatcaagtatgagccctcaagactccttagccacacacacccagtcttcccattttaggaaatgaaaccaccattcaatcaacttgctggccaaaagcctctaagattttatttccatttttgcttgccatcatgttttttttgtttgtttagttggttttggtttctttgctgctgttgtgttactgtttaggggtttttttgttttgttttgttttgttttgtttttgagacagggttcattatgtagctctggctgtcctgaaacttgatatgcctcctgggtgctggggtgaaggtatgggccactcaacatgttttgactgagtatctcacccttgtctaaagcacttctcaggtgggccgacaaagcaactccatggtcccctctgttcccacatttcattacagaccagtgggaaacctaaaaattttaaaacctaatcctgacctgggcttcaggccccaccggctcctatctccaccttgttccccttaccagctgctcagccacacagggctttaacacaagtcaactcatcagatgcagtacctggctcagtctacgctcaaaacacctggaaatggaggggctggagagatggcttaacggttcttcccagagtaacgggattcaattcctaacagctcatggacactggcagagacgctataactccagtcccaggggatccagcactcgcttctggcctgtgtgggcagcacatacacctggtgtatagacatgcaggcaggcaaaacacccacacacacatcagggacattaagatgaatcgggacttcacttgtagcggggtcggtcatctagcttcaaaagaggtatttattatcccgtgaccagatttgtcttttcaaagatcccactggccaaccataatgacatgtacctataaaaacagtgctgtggaggataaaggaagatcttgaggcccaaaaaacaagcaaacaaaatggtagcatgaggaccagagacctgtgaggagagatgagaatgggggctggtagcatgaagagtgaaaagtgacagatctcctcacacaaatagactatgctacactacataggcctatctgtcccaaccttgtacctgggtcacttttatatctccagtaaccagcagggcctggcatagagaaggaaatcagaaaatgttaactgaccatatcatctgctaaaactgattgagcaaagattcacaaagggttgaaacagggcaaggatggtgaaagaaagaaagaaagagaaccccagcatttatggtttccagtcagaggcagggcagatggtggtcgaggctgctctcaaggccttcctgaaaaagaccctgggttttgtgccttcctgcttaaactccaccccatctactatcgcttgtccctctagctagaaatgactctttcaatggcattgtggcagctgtgccagttccagagctctcagtgggactttcactccagagggacaggaggagctagtgtaccaaactctggagcttttggtgccaagagaaccagagggctaccgacacctgtcaaaagagcaagccaaaaggcctgtgtgacccttcctgaacctgcttcattagactaagaataatcagcctgaaccttactgtacacccaaggattatagaaaacaccaagtggacaaggtctggcatacagcatgtccttcttaatggatctccacccccacacagccaagaacccaggttccaaatccagccttatctctagccactcaacatatggtcctccccaacccctccacagtatgacaagcctacattctagctgttccaccaagacaacactaacttaaacctttctgggcctcagtttcagtatctccccaatagagacaacaatctactctgatagctgatgaactcccttaagttcctcctccctataatgggatagcatccatatcatgctggtgactctctccaacctaatggggtcttgaaatgattttaaaagctagccagactgaattgcttttttttggggggagggggagtgattggtttgtgattttgttttgatagtgtctccttattttgtccaagttggcctgaaattcactgtatgcccaggctgacctctgatggatccctcagcctcagaagtgagtgctggattacaaacttgtgtcactaatcccagcctgaactgaatttcattagtgtgttcccttgcatacagacagcagtgaaagggatgacgtattgggtccaaattctaggtaagcacttcccagttgcaagattctggaaaaaataactcccatacctctgaatttttatcgtaaaaggagaatcgttctttccccagggagctacagtaataaaacggattagtctagaataatggcagtgcctatcccattgtaaacgctcaactgaacgttgtttactcagtcagccttctatcactggaacaaaacgaagggtaatttctaaccactccaaattttcttctggccttccaccagacaaccccacagactgagctggccccaagtccccagtgcaccagggcttgtcttccaggcctctcctcactagcacctggagcacagtgcgctctccggccaccctcaaggcccagaaggcggtggacccttgttgggagccacacagaccaccagacgccagcgcaagagccgcgagggcagcttcccaagggccagtctctcaacgagaagcacgctgccgaagcaaggatcatagcccgcgccgccgctcggggcgcctgctgcggggcacggtgggacttgtagtccgtggctgcttcccacagctagctctctgcggcgcgtggactccaacccccaggcacctgcaccgccaggccagcgattctagggggtcccgggcgccccgaggccgcttcctcgaccagacgccgattggtacggccaacaaacccagggcagggagtcgagtcgccgcggaggccagcaccctgggactcaccgactttgtagggcagtttatcagacatgttggcggcgcttccgctaggaatgacgaactcagcgaatggggccggacggcgcgaggcagggatctacgcctggcgcccgcgtctttaaatatcttcttatttgaatattcatgagtcccgctagggctgagacttgggggcggagcctagctcgaggtgaagcgctgagccgccgcagggctggacttcgatccctaccacagaaattatacgttttatgctctgtagcctttggacctctggcacccggctggaagggagcatggagagaggcagttcttctcccagcaagtgaaccagaggtcaaaataatgcagaactttcaggctctaggcaatttacttcctgagccttatttcttaaggtatcaatgggctgaagactgactaccgcactggatacaagtaaagagctgtgatacatgcctgtaatcccaacactagggagacagagccgggaggattgccacaagttcgaggtcagtctggtcgacagctagttggttccaggccagtctctcccctcttctttctttcttttctctcttctgtcatcccccctctgcccaagccattatgttgtccagactagccctgtcccacttcaaacttgagatcctcctgcctcagcttctcaagtgctgagattacaggcttgggccaccatactgggctaaccttttctcctagtaaattgattgtctggagtattttgttatagctatggaaagctgactaacacagaagtattccttcttctgttttctagatgagactatacagaacacctattaactcttttaaaaacttttatttgtgattatagggtgcgtgtgtgtgcgtgcgtgcgtgcgtgcgtgcgtgcgtgcgtgcgtgcgtgtgtgtgtgtgtgtgtgtgtgtgtgtgtgttttatgtgcaccacctgtgtgcagctgcccttggagtccaaaagggatcatattccctggaattggaagtacagggagttgtgagccaccttaatctcaaatggaagtggaccaacctagaactccaacccacgtcctctgcaaaagcaataaccactcataacaactgagccttctctccagtctctactaactctctaatctttttgttttggtttggtttttgttttttcccagacagggtttctctgtgtaacagccctagctgtcctggcactccctctgtagaccaggctggcctggaactcacagagatcagtctgcctctgcctcccgagtgctgggattaaagacctgtgccaccactgcttggaaactctctaatcttttgaagtattccccagtaaaactatttaggcttgggcatttctttatcgagagtgttgaatatacaatcagttttattttttacaatttatttatttatgtatttctgtgtgtgcaggtcatcacagcttgcatgtaggggtcagaggacaactgagggacttggttctctccatttacttctgcgggtcccagggatcaaactcaaagcatcaggcttggtggcgattacctttgcccactaagcagccatcttgctagcctatgattcgagtcttttttttctttagagagacagggtttctttggctgtcctggaactcactttgtagatcaggctggccttgaacttggaaatctgcctgcctctgcctcccaagagctggtattaaagatgtgtaccaccactgcctggttcttaatttatttttaataacatttaaacatatttttaacatttaaagttttgctattattattattgatttgtgtatatgatgtgtgtgtatgggtacacatgcctgtagctggaattttctgtcctgccagccagctcccaaataaccacacagagacttattaattatatgtgctcagccagcagcttaggcttgttactaactagctcctacaacttaaattaacccatagttcttatccacattctatcacttggctcggtacctttcctcagcgtggcatgttcatcttgtttctccccagtctcctagtgaccctgcccttcttcatcccagagctctctccctgtccacaagtcccacctaacctcttcctgcctagctattggctctttagctctttattaaaccaatgagagcaacacatcttcacagtatacaaaaagattgttccaccataatccataactgcatcctaaatatttatccttatacccacagattggtgtagttctcatccctcatggaggaatccttacaaaagacagagaccactacagaaaattacaaccgatggaaatgaagagctgtagagcccagtccatcagcctctcactcctgcacctgaggctcagggtcatgaaggagggagcaggaccttttgtttgtttgtttgtttgtttaagatttatttatgtattgtatatataatgctctgtcttcactccagaagagggtatcagatctcattacagatggttgtgagccaccatgtggttgctgggaattgaactcaggacttctggaagaccatccagtgctcttaacctctgagccatccctccagcaccggaagaaagattttaagagccagagaaacaagaagtttggtgtgcgactgtgtgtcataggaatgtcagaggggctgcagctatgtaatttcagcaacatagctgtctaaacatatcctgaagaggaatgacacaaatggacatgctaacgtggaaggggggagctcaccaagtctcagccctagacaaagaacaggcagctaaggaaggcagagacgaggagaaatagtcttccccaggaaaaaacatgtcattgctgcttatctgatatcaattagtcagccctgaaaacatatgcatacaagtgacattatatggattgagtaggttgtatttttgtattaaaaaaggaatatatatgtatatatgcacgtatgtatacacacacatacacacacacacatacacacacacacacacacacacacacacacacacacacacacacacacgtcatcaacaattaaagaaaaaaaggccatgaatttgaagggggtggaatggcaggtggcttcttgggatggttagagggaggaaagggaagggcgaaatgatataattatagtataatctcaaaaaataaatcaataataaaaagattctcaagccagacatggtggcacacatctttgatcccagcactcaggaagcagaggcacgcggatctctgtgagtttgaggcctgtctaatctacagagtgagttccaggactgccagggctacatagagaaaccctgtcttggaaaaaaaaaaaaaaaagattctcctgtggttcagtaacttaaagttttcaagtaaccatatagtaccacacacacaaaacaaaattagatgtggtgcgatgctgtgcatctgtattcccagcacttctatggcaagatgggaggtggagacaggaaaatccctacaaatttgtggaaatttacaaagcttaagcagaaacaaaaaaaacaccctgacataaaggtagtactgaaagttgtctgctggcctctatatgtgcactgtggcttgtgtatactggcacacatacacaagcatatgagtgcacacaataataaacaaattctctgaggcttcttgttgaccagtgaactatttagacatgcgttgtttagctttgaaaggttcagacattttcccattattgttttgtcattggtttctagtttgattctattgtggttaaagaatatattctgtatggttttgtttttgtttttttgttttggtttttggttttttttccgagacagggtttctctgtgtagctttggagcctatcctggcactcgctctggagaccaggctggccttgaactcatagagatccgcctgcctctgcctccttctgtatggttttaatgcatttcaatttgtggagatttgacccacatcatggttagtgtctttgagtttctgttgctgtgaagagacaccatgaccacagcaactcttagaaaggacaacatttaattgtgggtggttcagtccagtctcatcagggcgggacatagtgcaggcagacatggacttagagaagtaactcagagtcctatgtctttccaaccaccaccgtggcaatttttactttgaaaccacttggcagatgaacctttgggcatgcatatgaggggctatttggattacattggttgaaatcagtttgggaaaacccattttggttgcaccattccctgggcaggtgtagcaagaaaaataaaagactcggagaccgatattgaggttcaagcttcaagcttcaagctgaagatcagaaaaacaaagcaaccagcactagctctcactctacctcagattgaaaggcgatcctggctccaccaaacctctgacagctgcctctcctcagtgtggctggagaatcctgagaattcaatgtcttcctatcttcaatgtggctggagaatgaatcctgagactgagaccctgctcctgtcttatatacctccctaatgctgggattaaaagcctctgatcctaggtgctgaggtcatctttttgtgagctgtttctcttttgtttttcaagacagggtttctctgtattgctttggaggttgtcctggaactcactctgtagtgctgggattaaaggcatgtgccaccaacacccagctgtttctctttaggactgcatcaatcttgtgtagatctgggtggcattgaactcacagaaatctgtctacctcttgaatcctgagtcctgggaataaaggtgtgtaccaccacttcctagcttctgactgctgggattaaaaggtatgtgcctggcttctatggcttgtgactaactttgctttctgaatccacaggcaagctttaataaagcataaataatataccaccacaggcaggaggccctggaactgtgtaagatgaagggatattagcatgcatgcactcctctctcctcactgagagctggatattagcgcattcgctcctctgtcctcaccgtggacgtgatgtggctgctgatacaaagctgccttgacttcctctacatgacgaactctaccctgaactgtgagcgaaaatgagcccttgatgtttctttggtaaggatttcttctatcacagcaaaaaacaaaggacaacaacccaggatgaggtcaatcttggtgcacgttttgcaagcacctgaaacaaatgtgtgttctgctgttgtttagtgaatcagcgagatgccaaagacatgcttctggctaatggtgatgcagaactctatactcttgctgattttatgcttagccattcttccaaacgaaagagctattgaaatttgtcctttccaatccatcagcctttgcttcatacattttacagaactgttctttttgcacatacacgtttaggaccgttgtgatgtcttaggggttggctcttttgccctttcataatggaaaggaaagatatgagggacagggtgtctcactagtgccctatgggagcggaaagtctaccactacattgatgtgatttgaaaaaaggtaatatttgggtttcttttctttctttcttttttttaaataagatttatttatgtatccagtgttctgcctgcaagtatacctgcaggccagaagagggccctgggtcttgaaggatggttgtagttgctgggaattgaactcaggatcactggaagagcagccagtgctcttacttgcctgagccatgtttttaaatgtgactgtacactgttggtaaggctttagggaaacagcccccccccaagacatagaatgtagaaactttcataaaccacactctggtaactgctgacaagatagcaaactcacataccctttgaccaaatagctccactttgaggaatttaacctaaagatgcacatatgtgtgaatgatgatggtaaaagtcagaggctggaaaaggcagacacagccttcagtagatttgttaagtgatggtacaatccccagggagaaatatagtaagatggctattttttaagttttttttttgtgtgcacgtacacatgtgtgagtgtgtgtgtgtgtgcacgcacgcgtgtgtgcatgcctgtgtgcgtgcgtgcgtgtgagggggggtatgagacacagcattcatgtggaagtcaagggacaatttgtagcagtgagtctctccttccaccatgtgcgttctagggattgaactcagatcattaggcttggtggcaagtatcatcacccattgaaccatcctataaagactgccagtgtttaatgggagatgtttattaatatcgaatttcaaggtgtgttacataaagaatcagaaacaacaatgtagagaacaagtgacctataatgctattatttatgtaaaagaaaagggaacaactgggtctggcagcacacccgacacttgagagtcagaggcaggaggatcagaagttcaagggcatcattaggtatataacaaatctgaggccagcctaggctacttgagattctgtctcaaggtgaggaggagagggggagacacagacaaactgggatttacctataatcacacatgtaccaggctagatacaagggactgctaacaatgccagggaagtgggacatgggctccagtgaaaagcataatgacttagacttcttcctctaaatctgtgctccagggatgcctctggcaggctgctgggctcccaacccctgggcagaggcaagctgccccctccacttgccctttgcaccccctttccctgtgtgctttttcagacactgagctccctgttccaggggtggggagagcaggatctctgctattggttaagggctgttccaggccgtccactccaaagcatcctcacttgccttcctatgctccagcctctctctcactgtgggacaaaacaagggaatgaggtccaagtgttgaggacacctgctgacatcaggagacgggctgaactctgaccttctgagatgaccccaccaccaccactggtctatccctgtccagagacctctatcaccttctcccatgaccctccctccaggtcccctcctgggtgtaaacaccctctggggtctgccttgaggtgtctgatgccatgtaaccatcttccagtccttgaaatagttattctccctcctacctcagcccttctcttcccagattgctgtaggtgggtgaccagagttccagaaactgcctttacagggccagctacagactcaaccgctgggagaccacactcctctcctcccagtctgagcttcagtctgtccacctgcaaaatgggtatagacgtaacggtgtctgaactgtgtatatggaatgtatgggggacactttcgtaacttacccaatgacatgtttgtcccattagcagaaaagtcagaaatgtgtctagtttggccaaatgttcattctccaagggtcagttcagcgtgtgatacacggtgtttgtgaaatgactcttcctgaccattgccccagcctttgcgcttccggtctgatctcaggtgttcctcgagttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggagggaggggggaaaagggaaattttgcagcagaatcttctgtagctcagactagtctccaacttagtaggcagctgaaggtggccttgtactcttctacagatacctggctctggcacaggctgagaggctcatcatggctcctgcagcaatgctgccatcggtaggctgccccccctcctcacttctcaggcgacaaccctgcaaaggagtgcactggggatttggaacaaggggcttggcccagtttgatgggcaaggccgtctctagaacgagtttagagggaagaaaaaacaagaaagcaggtggctcttagtcgggaagctttaaaaccatccccttcagcctcctctgccctggccaggctccttataaaggagacaccccgcgctggtggcgcccttgcacctgggaggtcagccttcttcaggctggagtcacctttaccctactccgccaggcgagggcgctctgcacccatctttggcttctgacggaggcaaactcctctctcctgacaagtgcacacatagcttttcatggcctgtcccatagaaaaaatggagggtggggaaaaaaaggatggcccttccttgtcaatgacctttaaacttgttctgaacgacttgggcagaaccaggcactgattgtgacaccagttatagttgtcgtttgttggatacatctttgctctccacgtttttttgtgttttttgttttttcttttttgaaagaggatctcaatgtgtaggtcggctgccctggaactgactatggtgtaaaccaggctggcctcgaactctcagagatctgcctgccccacctgcctctgcaggtaccgccagactctgccattctccacggttctaaactctttagtctgtttgtaaggtagatgtacccatttacagatgaaaaactgaggcccacagtggtgatttgccaacaagtaagaagcacccacaggcgtgggggtagctagagagatggctcagtggttaagaggactggctgcttcttctagaggtcctgagttcaattcccaacacctatatggtgactcacaatggtctataactgtagtcccatggaatccaatcctctcttctggtgtgaagatgtatgtgcagacaaaacacccatatccataaaatatgtaaataaagcacccaggaaaccaagtgtgggggcccacacctttaatccccgcaacactcaagaggccagcctaatctatagagccaattccaggacagccggggctacacagagaaaccctgtctccacaaaccaaaataaactgattagttaattaattaaaacaataaaggaggcacccatgctgtttgaccccagagtcaaacagtcccagctaactcactctgctcctcactctgccatcataccatataattttcatttgaaactgtcagatgcaaagatgtaaaagaaataagacaaagtccctgttccctggacatttttttaaaagactttatttatttattatgtatacaacattctgcttccattcttccaccagaagagggcaccggacctcgtgacagatggttatgagccaccatgtggttgctgggaattgaactcaggacctctggaagaacagtcggtgctcttaaccgctgagccatcatctctccaacccattccctggacattttaacaaacacgtgcatttacacataggaacactcacataaaactcccttgctcattcatagacaaggttagtccgggatctgccccttactatcagcctgcttactttgctttgttttgatgtgatgtgtgtggtgcatgtgtatgtgtgtgatgtacacatctgtgtggctatctgtgtgtgcccagcatgtggaggccagagggggcatcctgctttagcattatgccttagtctcttgagacatggtcttcacctggagtcccccgacccccttttctggcttggttggctaacaagagctagcagtcctctccatgacttgccacttgctctgtagttgcttcagattctcgtgtgtgtgtgtgtgtgtgtgtgtgtgtgtgtgtgtgtgtgatatatatattctctctacacctgactggggctgatgctggcaggcatcatctctacattcttgttttgttttgttttgttttgtttttttgttttgtttttggggggttttgtttgtttgtttgtttgtttcgagacagggtttctctgtggctttggaggctgtcctgaactagctcttgtagaccaggctgttctccaactcatagagatccgcctgcccctgcttcccgagtgctgggattaaaggcatgcgccaccaacgcccggctccatctctacattcttaagaccgagtgcccccatgcctcttggattcagtgtcaccaaggaaattgctgatctgccaaagaactctccggtaaataaaacccacctctaacgatggtattgtttggtggggttggtagttgtgtaaaatgtatggtacatgcctccagattcctcactcgagtctgatgctcaaaaggctctgaactccttcagaccagaacccaaaccttggggcatctcttcatcactgtatccagcagagcctaaccaggacagctacctggtcaaggcttgtaaataggaatggatgacacatagattgagcagaggtcgtagcatagtggctgttgggatgttggccccatagttgttctctaatgtggtgggcaagcctgcaagcttccttctctggtgatacataaggtctctaggccaacatcagcccccaccctttgtatgcctatataaacccctcaccaatgttcttgcaagatcttagcccaaccacggaaggctgagctgggtctgaggaagggtaagtgtactgctcacccgttccctagccttccaggatcccagagacaatcagattcagcagggagcctagtcaagcaggaacttgtttattgtgccccactgcaagcatcttttaaagggaaaaaaccacagagcatggaaaacagccaaataataactttaaaggtcaacctatcatgagtctaggcgtcctatgctttacctagtggacacgagctgttcatgtagtgtctcatctggttcaatctaggcaaccaatcatctttttttgtaaaccactcaatactcacccatctgacttctcctcagtgccatctttgactggctcgtgtgccctacagttctctctgtggcccagaatcatcttgatgaacacaggatggcactctcatttgcatggtaccaatggagctctttgctcctgtaccagatgtcaccatattgcagaattccttgtgttagtatgatttgcctatcttcttgttggctgtcactcttgttaccagcaagtcacctctcattttttgctccttctctgacaaaggggagcctgctcaatcaaatctcaaagtaggataaatgagaccctgtatggggaaccactgctaataccaatttccaggaaccaagatgatttctagacttgctctggaaatacaggcagggatggtgttgtgagttcaatggtgggcctctgcctaaagatgcttctagcatttgtgactgtgactttacctgggagaaaaaaacctaaatccaatttaaatgtccttataagagaagaaaaaggaagagtcacacagtgaagaagacagagggaggttggagttatgcatccacaggcaaagaatgccaactatatcagctacttgtgaagctcatcaattccctcgctttttttttttttttttttttttttttgggtttttttttttttttttttttaagattttatttgtttattatgtcttctgcctgcatgcaagcagagggtaccagacctcattcaaggtggttgtgagccaccatatggatactgggaactgaactcaggacttctgcaagaatagtcagtgctcttaaccactgagcaatctctccagcccagatagggtttctcactgaaccaggagcttgctaattcagcttttctggccagccagcaagtcctggggtctgtttctgcctccctggtgctggtattataggcatgaacttccatccctggcctttaatttaggttttgtttgtttgtttgtttgttttttatttaatgtatacaggcgttttgtctatctgtataccatgtgcatgcctgttgcctgcagagctcaccggggacatttcagaaccaaaaagtaacaccaaggcctgccaacagtcgccagaactaggagagaaccttgggacactatactactcctacacatgattgtggacttacagtctcaagaaacgtgaaggtagtgggcaatggtggctcatgcctttaatcccagcactcagggttaaagagacagaggcaggtggatctctgtgagtttgaggccagcctggtctacagagtgagttctagtaagtcaaggctatacaaagaaaccctcttttaaaaaaaggaaaaagaaaaaaaaaacgtgaaggtataaatttctgctattttaaatcaccagggctgtgggctttatcttggcagccctagaaatctaacactgctgggaagtggggagtcatgggtagacaaggaggaagctaactggtgactggtgattcagtgtcgcttgttctgtctcttgccaccacttcccgtaaagaaagctaagttgatggaggctacagtgagacttgctatgtcatgccaagttctaaccctaggattccagagcctcctgggctgtgaatcacccatgagctgtggttttgctttaagcaactgtgaggaagtgttgtcataagggcggcactctgagaaagaggtaaatctccaggccctgctagtggaggtgcacatctggcattcattccacacagggtgcctgggtgccttgtagttgcttcttccagaggaagtaaagactgaagcattgacctggaagaacaaagagaaggaagtaagcctggggtgtgtcccctaaggcaaaaatgatgagagagggttggatcccgcatctaaatctgccagttttcttttgtcccttgtctatctaacaggatctcgtgataacagggttgcgttaataattcatatttcagtttcccctttctaatagagcaaagctgtgaagtggagaaagggtaacaaaaggccgtggagaaggacactgaaaggtcatccagaagacctggatcccgaaatgcaaacatcggcggtctccttaaatccacgcatccaggaaggtgttcataacctcttctcaagtggccagagccaggatcatacagcataaggatgaagctgccctctgagcatgcccatatacttttctttcttggctatactagggatccatgctagcccaaatgcaaatctgtctttcaggagccattccacctgccacaagtcatttttttccaggtctaaagcagaggtggactctctgggttcatttccacctttggataaaggacagtagtgtagacccctagtgctgctgagtaagtaaatgaaatgatgaatgtaaattctttagtgccccatacatacttggtattccattttgaatcattattgttgaggggagtcccatgaaacccctctatagagggtttttccgaaattacttactcgtggcagggttgtgaaaagtaagtgcaggtcagagaacaacttgcaggtctcaggacttgaaccccggttatcaggttgtcactgaaccatcttgatggccctgtctataggatttttgagcttctatttagtacagagcctctagcctccctccaacagggaaatacaaagccacgctggacaggttgtctgagagacgacatggtagcattccaggcctgcactgcatatgggtcctgcctgttccccagtgtgggtgatgcaggtcctaggatccatgaaaatatgacagctgagcaccccagagcactttgtctgccagacccaagtccagagcttggtccctagactcactcaccttatctggaatgagtatgtggtggccaagcaacaccacctgacctcatcaacctagcagtccagagctcactgtggtggcagaggaaggtcagaaggaaaagaagttcaaaatccagttctgcaggggctgcagagatgactcagcagttaagagcactggctgctcttccaaaagacctgggtcaggttcccagcaccttcatgatggttcacaatcatctgtaactccaaagggatttgatgcttgtttctgtgtttctgttggtttgttttgtttggtgtgtgtgtgtgtgtgtgtgtgtgtgtgtgtgtgtgcgttatgcacgcactggagaccagaggaagaaatctgatgtcttcttctatcagtctctactttattccctggagacaaggtctctcactttgcttggcactcttccaggtttgggctcagatggcagtcagcaagccccagagaccctctgactctccaccctcagagtgttgggtttacaggagcactggccatgcatgggtttttgttgttgtttgagcgtgttgaggcagagtttcactatggagctctggctaacctggagctcatattctcctgtctccgtcggctactcagctgggtttacagttgtgcactattctacctgacatcaactgcttttcattctttagaaccaaaatgatcctaatttatcccgtctccctcctcacatccaaacgccagctctttacagctctgtactattcagtgactttccctcctgccctgcctctcctggcctcctcttcatttactgcagactggctcctgccctgtgctcttcttgtccctcctaagccctcccatccccttggacaattgtcatttcatgaggttgaccactccctaccttggcctcttgactcctcacctcctgaccaccccttgaccttcaccgccacttcatatcatcccctgtcctcagtggccacaccttggaccttatcctttcttcactgacacagaagtttgctacaaattgcctaaagtccaactgtagaaggactcagcaatagaaggatgtcattctcccagatttacaagaatcagtacttggtgggctccaggtacatcaattcagtgacatgtctgtaacttcaacaactacccaggttcttctatctcccttttctgctattctcaggcattgtctgggtcatcagactggcttctcacatgctcagcagatagttactgaaactgaaataccttatcgttaggactgtgtccaaaggcaggaacaagggcctcatctttcttctgccactttgtaacaaggaaggaaaatctccaagccagcatagaggtgcacactcatgatcccagagagtcaagagtacaaggttattcttgactatatctagttccagaacagcctgggcttgtatgagacctaatttcaaagaaaataaattttcttggatgttttctgactccaactctgactgcctatattattatatgtgtgagtattttgtctgtatgtagtatgtatgtgtaccacatgtgtgcagtgcccatggagacagaccagaagaagatggcagatcatctgggccaagaattatagatggttgttgttgtggggtatccaccagaaaagactgctaggacatggatgtaagataatagaaagtctttattagcctgcctatgtgttcaggatcccagtgtagccccaagcctttctcagagtgagattttaagcacaaaaccatatcctgagttgacatatatcagttaacaggaacagttaaccagaagaggaactacagaggccaaaaaacaaaattggtacatttagagactttcccagaactttctcaggctttgatgaattgggtcttttagttttggcaggtggtactgtctacgtgctgagttttacagctgaatggtacctccatcatggagtcatctatgctaaggtcttggggggcttggtaggtctagggccctgttatagttgtcagccaccatgtgggtacagtgaaccaaactcatcaggtcctctggaagagtagcaagtactctaaaccatctttctggctgctctctctctctctctctctctctctctctcctctctccccagagtcttatatagctcaggttggcctccaactcacaatgtacctgaaactggccttgaactcctgatcctcttgtctctacctcccaagtgctaagattataggtgtgatgacctcgcccagcttttcctatttcttccctgctagagctggtttttctaagaagcccaggctgaactcaaaactctaaatcttccacccacatatcccgagtgctgagattataggcctgtgtgtcttagtcactgttctattgctgtgaagagacaccatggccatcaaggcaactcttataaaagaaagcatttaattgagggcctgcttacagtttcagaggttagtccattatcatctatcatcatggtgaggagcttggttggaaaagtagatgagacttctacatcctgatcttcagacagcagaaagagaacctgggcctgtcatgggcttttgaaaccttgaagcccacccccagtgacacactttctccaacaaggccacacatcctaatccttctaattttttcaaatagtgctactccatagtgattaaccattcaaatatatgagcctatggggaccattttttattcagaccatcacaccatgctctatgcaaggatatatagatatagatatagatacatgaacaaatgaccaaagtcatgctgggtatgttccaaattttatacttttcatgaacacactaagatctccagttggcaagatgaaagttagaaagagctttctgcagctagagaagtaattcaacaggcagagtgcttgcctagcatggtcacatatagataattaacagcaaactcaaggtcagtctgtggtgcataagaccccatccaatgggtgctgcacaaatgctcagcagttaagagcaccagctgctcttgcagaggacctgtataaggttctcagtatctacatggctgctggggatctgatgctgtcttaggcttctattgctgtgaagagacaccatggccatgacaacaggagcacatttaattggggctgactttaagtttctgaagtttagtccattatcatgacaggaagcatggtggcatgcgggcagacatggtgctggagaaagtagccgagagttctagatcctgataggcaggcagcagaaagagtgacactgggcctggcttgagcttctaaaacctcaaagcccacccaccatgacacatttcctccaacaaggccatacctccaacaatgccactccctttgagtctatgcgggccattttcattcaaaccaccacagatgccctcttctgactccatgagcacttcatacatgtactgtaaagacatacatgcaggcaaaacaccaatacacataaaatataaatatataaaccttaaaagacaaacagaacaaaacagcaaaccaactttctagaaaaatattggcaacttcagtatataagaaaaggagaagaaaaaggaggaggaggaggaggaggaggaaggaaggaaagaaagaaagaaagaaagaaagaaagaaagagaaagaaaaggtaatgattccttagctggatggcggtgaatcatacttttaattccagtactagggattaaagaggcagaagcaggtagattgctgtgaattcgaggtcagcctggtctacaaagctagttctaggatagccaaagctaccaaagaaaccctgtcttgaaaaacaaaaacaaacaaaaaaggtaagatcccctacccagtgcaccatcacagcctgccttaggaaacatccatgtagatataaagtagtatgtacaaggatgtccactttaataacattttttaaatatttgggttttttttgtatttttttaaagattttatttatttatttatttattatgtatacaacattctgcttccatgtatatctgcacaccagaagagggcaccagatctcattacagatggttgtgagccaccatgtggttgctgggaattgaacccaggacctctggaagaacggccagtgctctcaactgttgagccatctctccagcctcaataacattttttaaagggggaaagatgggcaggaacctaaatacatgccagggaggaagaaatgaacaaattgcttccattttcaaagtcacttaggtcaaaagtgaactcagttcaaatgctgctccacccactagcgagatacaccatccttcatttatttggcagggttgcatcctgagaaattcatcatttggcaattttgtcattgtgcaaacatcaaagggtacttatgcaaacatatatggcatacatatggcagccacgcaacatggcctcttgatggagttgagacattatagaaacaagatgaaagaggctttgtcagtgtaacacagtacagttttgtttttcctgtttgtttggttggttttttgtttgtttgtttgtttgtttgtttgtttgtttgtttgagacagggtctcatgtagcccaggttagccttgaaatcacaatgtagctgaggatgactttaaattcctgatcttcctctcttcacctcccaagtgctggaactgcaggcctttgccacaacgccagcctacagcctttgttgagagcattgcatgacagtacccaccaatcaccagagaaaccaggaatgttaagcacacaggattgtctttccaatgggaaagatgaaaaacctgttcttccacccagaaagctgagaattggaaatgattaacaacctgatgatctgtgttctctgttgggccaggccacatcaagctcttacaaccaagactgggaggtagctagtaatctaaatgaccctgatatccagaggttcccccaagctcccacactaggaccagaggtggctaataaccaaaatgagctctacattagctatatgaccaagaccaggccagacccttaggctgtaagctcgtttgggtagcctatctccagaacccatcttcttggaagaaatgacatataccccgaggggagtttcaatgtaattacacttctttgtgcactaaggattgtattatatcaggaaactttttacccccaaattgccctgtacttaactattgggaaaaaaaaaactgtctgttagtagacaccccacccccgaagtctgatccaggctgatgaagtcaatctgcacctggtttttattcttgtcttttcctgatattcacttccccgtatgacacctgcagggacccccatgagcattctcttctacagtgaatcttttttgtttattttttttgtgttctgagacaggttttctttatgtatccctgcctgtcctggaactcaccatgtagaccaggctggccttgaattcacagagatcctcctgcctctgcttcccgagtgctgaaattaacaatgtgcaataccacctcccagatacagggagcccttttttaaataagatttttttaaaagattttttatttatttattatgtatacagtcttctgcctgcatgccagcagagggcaccagatctcattcaaggtggttgtgagccaccatgtggtttctgggaattgaactcaggacctctggcagagcagtcagtggtcttaaccgctgagccatctctccagccccttatataagatttttaagacccatggtttattgtctttatcatgtattgtgtactacacacaattgtactgctgtaatgttttatgctggcaatgcagtggatttacaacaggaatagcacaagaacagagcagtgctgtaacagtaacaggaactacagcatccctgggaaatgggaaatttccagcttccttataattttaaaatattttagatttgttcattttatgtgtatgagtgttttgctgacatgtgtatctgtgcaccgtgtgagtgcctggtgcccatggaggtcagaagagggtatcagatcccaggtcctctgtaagaacaaatgttcttaactactgagccacctacctctccagctccaactatatatgtatatgtattgagattaggcctttctatgtagttcattgtcctagtttgctttctattattgtaatatttggtgaccaaaggcaacttggggaggaaaggatttatttcatctttgcttgtttgcttgcttgtttgtttttgtttttcgagacagggtttctctgtgtaacaaccctggctgtcctggaactggctttgtagaccaggctgaaactcacagagaacctcctgcctctgcctcttgagtgctgggattaaaggcaggtgccaccaccacctggctagcgtttatttcattttacagcatccatcactgagggaagtcaggacaggaaatcaaggcaagaacctagagacagaaactaaagcagagaatatggaggagtgctgcttgctctccatggcttgctcagcctgctttctttattattattattatttatttgtattttgtgtacattggtgttttgcctgtgtaaaggtgtcagatcccctggaacaggagttagatacagttgtgagctgcatgtgggtgctgggaattgaactcaggtcctctagaagagcagtcagtgctcttaacccactgagccatctctccagctctcagcctgctttcttataccagatgaccctagcttgtgtcaaattgacataaaactaaccagtacatccatgctgctctaaaactggaaatctccagcctcagtctctcaagtgctggattgccaccatgacctgctttcctttataattctaagggaccactgtcattttcttcattggtcaaaatattgttatgtaatgcatggctataaacctctccctcttcccctcttcccctctctctcttctctgcctgcttctctccctattcctccctccccccttccctccctcccctctctttctcatagtgaagactgaccatgttaggcaagtgctctaccactgagccatatctgcagccttcttcatctttaaaatgggtaaaaatgatagtgaccagttgatagcgttgaaatgagacacccatgtgaagcagataggaaggaaggggtctcataagcattgagtatattttcacaaccccacatagtaaggaatactgagtagcaatttaaaaggtatgaattcaagggctggagagatggctcagcagttaagagcactgaatactcttccagaggacctggaagtacccactgtacacacacacacacacacacacacacacacacacacacacactaattcaagctgggtggtggatttctgagtttgaggccagtcttagagcgaattccaggacaaccagggctacacagggagtctttgctcaaaacaaacaaacaaaaagtactacacccttagtcttagcactcaggaggcagaggcagaggcagaggaggcagagaggcagagaggcagaggagaggcaggagacaggagacagaggcaggcagatctctgagattgaggcctggtcttcagagttcatttcagaactacacagagaaatcctgtctcaaaagaccacacacacacacacacacacacacacacacacacacgcgcacgcgcgcgcacacacacacactattgtactgccgcctgctgcctattgggcagagatggaattacatttctctttgctctgtcttttctttcatgatcctaaacaatctgttttagaaagggatggagctccctcttcacaattcctatagggcttaatactagggagaaacttagaaaactaaaggattatgggggttggtaaagtgcttgctatataagcgtgaggacctgagttttcgtatcagcgttcacagtaataaaacccccgagctgggcagtggtggcacacgcctttaatcaagcacttaggaggcagaggcaggtggatctctgagtttgaggccccccgatctacagaatagattctgggacagccaaagctacacagagaatccctgtcttgaaaaaaccaaaacaaaaaacaaaaccaccaacaaagtagtactcatcagtagccccagcacatgggcatagagacaggtagctccctgggcacacttaccatcaagtgtaactccagtttcagcaagcaactttctctcaaaaaataaggtgaagaagacagagaaagatacttgacctctggcctccatatacatgcatgggtgagtgcacgcatatgcacaacacacacacacacacacacacacacacacacacacacacacacacacacacaaaataaatctttaaaataatgatatgggtccctaagtactgaaattggaagcggcacccacaccccaatgtttgcagaatgtcactggactacggaataagggtaaagggatattcctcatgctaattattttgaagttgtttttcgggggacagtaaatgtcaaattctttcccttaaccatctctgtctcctttgttcctttgcaggggctgagtcagcctgttgggtgacccaggcctgccctaggggagggaggaagctacacaactaagtcctttgagcctctcccctgtccagagggcatcagcaattggaaaggagcccagctttatgggcaaacaatggtgccagccagctgcagggctcaacagcctggctaatctgggaggtgtccagaagggtgcccctcatacctgaagggtccacttcacttggagacaaatatccaccaatcagggaataggtcacgaagcagtttggcaagggctggggagagtcagggaccattgagagggaatccctcagcattcctggtgaacacctctcaatatgaaattcccaatctccctgctaggggacctcagtgttcctgggattgaactattctggcatatggggggagaaagcaaaggatccctaaggaactgaaagttgtttgaggtcccataggaaatcaaccacaaagctgggactaaaatccaggttccctttgacacagcaagtccacaccaggaagtgatgtttgcacaactttatgagcatgctcaattctgtgtctttgataaatgtccatctgatacagaagatagtgtctgatcacctgaccactggaatccgaagcaggatcccaagcctggagacctcatggacaagagcaatcagcagcacttgcctgtctgactgtcaaggctgtaatttggtaattgccttgagttcaaagcctgcctccaaaggctaggaagatgcccagtgggtagagggattgctgtacaagcatgagtctcagagttcgaatctccagaactcaggaaaaatccaggtatggtggtgagcctctggaatcccagctctgggagggagtagactcaggtggatcctgtgggtggggctttctagccagccaatccagtccaaaccatctagctcccagttcaaggagaaaccttgtctcaaaaatcaagtgcagaagcaattaaggaagacactcactgttgacatgaggctttgacatacactcatatgagcaggcacacccccagacacataccacacaagcacacacaacctccaactaacacttcctatgtgtgtcacctgctatgaattagtttgttgctgtggtagtggctccaagatggccatcaatgaccctgaacctcaggggtctatccccttatctagacagttcctgtagtgtatctttttccttctgtaggcagttccctcaatggcccttgcctcagggtagctatccccttgtgttggcagttccttctgcgtgaatgccactgacttctgtaaccactggaggactgtagaagtaaaagcccaacttcagagaaaaaaaaaaaaaaaaaacactggaaggtctatcttgctctcttgaaccactgtctatgtggggagggcatcagaggctgtgtactacagacaggtagacaggtagcccaatggaagaacccacacagctgtgtgttgctgtaataccacacattatgctatgaagaagtttaactggctcaaagtcctcaaggtcagagagtctgagactgaaagcccagttctgctgagggtcttcttcataattcagcaagagaagtcatgtggccaagaagcttgtgcaagtgttggaggcaggggggaggtggggctggttttgctcttagagcaaaccccggcttctgaatatcaatccactcccacaatgttggttttagccttcctgacctaataaactacttgacaatccctggaacctctcaacacaatcagagtagtaagtaaacatcaatgtgagttttagaagggtcattcagaccataagcaaatttggagacccctccaacagccaactgacttgccagccatttgcatgagtcccctgagaactggatccggaaccctagccccactcagggctctagaagcctgaagcccgtgttcacatcttcactagaccctcaggacaattctagagatttcatgttttaagctgtcagttttgtagtaatttcttatgtagaaatgatgaatgcaaacattttccttctttcctttatctctttaaatttaaattttaccagaaaatgatgtgtgtgttccattttccaataatcaaataaagtctataaatatttgtcacagttaatataaaataaataaatttaaattttattagctcattatcatgtatgtgtataaagtgtgcacgtgagtgtgcgcacaggcaggccatattgcccatgtggaggtcagaggacaactgccaagagtcactcctctccttccattggatgggttctggatatcgaactcagattggcaggcttaggagacaagtgcttttccccactgagcatctcatcagctttctttatttaaaagtgaaggtgagtatagcgtctgcttcatacacacagaatgcagatccaaacagatgggggcaatgttgctacattattaggtagtatttagtcagttaaacttttgtttatttattactgcgattgtgtgtgtacacgtgtgctcttgagtgggcacacccttctctccttccaccttaagttccagggattgaacttaagttgtcaaacttgcagagcaactacttttacccactgagcctatcaccagccccatgtggtttttattaacagagagagagcatccaggtagggccaaaggggcagcagcacctggcctcttcattttttctagcaatttcattccgagttcgggtctgaaataccccccaaacccaagcacaaggacaaatcctgcagggactctgcatcccctctctctcccctgaaggttccagtttctatcgccccaccccaacctggaacttatcaggtaattcttggctcatctgctaggaggtctatgttcaaaaaatttgctccatctcagcacttttctgggacattccctgacccctgggagctgcccagctaaggattgttttgctccttaatccatctctgggaaccgggtttaaattttaactgtactgcagatttcacactttgaaaagtttctcaacctcgtgaaccccatttcttcatctgccaaacagagagagtgaattctgcctcctggctgctggggaaagaaaatagtcaggtatgaaaactgcagagtaaccacaagatccagcagttccactcttaggcatatacccaaaagagcacattcatacaacaaggacatctgttcaactatgttcatagcagcactatttgtaatagccagaaactggaagcagcctagatgcccctcaactgaagaatggatagagaaaatgtggtacatttacacaatggagtactactcagcggaaaaaaacaaaacaaaacaaaaacaaaacacacacacaaaaaaacaatgggatcttaaaatttgcaggaaaatggatggaacttgaagaaaccattccgatcgaggtaacacaatcaccacaagacaaacatggtatgtactcactcatatgttgatttgagacatagagtaaagtattatcagcctaaaatccacactgccagagaagctaggaaactaggaggaccctaagagagacgtacatgttcccctggagaaggggaaagggtcacgatcccctgagcaaatttagagcacgggaagaggagggagggagctacaagaatgagaagggaagaagaggaaggatgcagaggtcatgagggagcagaaaggttgagtcaggggaagaatagaagaaagggtatgtgataggtagggttttagttggggaggggaggggaggacgggagggagaagggaactgggactgtcatgtaaaacaatcttgtttctaattcaaattaaaaaaaatctgaaaaaaaaagaaaagaaaagaaaaagaaaactgcagagtaagataaactggaagccccctgcagctgtcaggtacagccccgcccagcatcttctcctcacagtgggagtagcttaacactcaggctctgccatgctttgtgatacagaccagctttgtctctttgaccatgggactttcaatttctttattaggctttcagcagaacgtgcaaacttattccagtactttccttcagcagctaagccaggttaagaagaagggcttgctgttgttctgttttatttttgtttttcgagacaggctgtagctttggagcctgtccttgaactcgctctgtagaccaggctggcctcgaactcacagagattcacctacctcccgagtgaggggcttaaacgtgtgtgccaacactgcccactttgttttgttttttaatgggctaacatttgatagcccaggcagaccttaaactcatgatcttccaggctcagacttccaagtacaggcattacaattgaaaataaatgattattattagtgtttgtatgtatggtgcttggaatcaaactaaaggttccaggtatgctagacagacattctactacttgactatacttttttgtttgttttttgaaacagggtttctctgtgtaacagctcttgttatcctggcactctgtagaccaggcagacctcaaacccacaaagatcctcttgctctgccttccaaatgctgggattaaaggcctgcaccaccaccaccttctggctttttttttttttaatggtttgtagagatcttaattcagctactcacatttgtaaggcaagtgccctaccaactcccagctcccaaataaattacttataagtggaatcttattagatattattagttcctaagtttggctgcatgttggaatagcctaagggtttaatgtacatacctccaaagatcctgatttagttgtctatcgaggattcggcctggacatcaaaagcattttaaaaccttgttcccctgaagttaaagggactggattatctagccatctgaaaacaagaatgggattaaatgaaacaattcaaatagggatcaagtagtgaaggaaagtgacccctgggatggaaacaaatgaaaaaagaccatggtgatggatttttctttgggccatcagtacacacacacacacacacacacacacacacacacacacacaacatagagacttatattagttatgaaagctcagccttagcttaggcttgtttctaactagctcttataacttaaactaacccatttctattaatttactttctgcctcatggctttcttacttcatctccataccgcccaccctgctttctctgcatctcctggaaatcctgcctcgctattggacattcagctttttcttaaaccaatcagagtgacacatcttcacagtgtacaaagagagtatgccacaagatttccacaagttaccatcaagacagttttcagaattcccacaaactaccgtcaagacagttttcagaattcccacaaactactgtcaagacagttttcaggtcatagaatagggaaaggaaatcttgtggagttccgcagactctggggggaaggaactaaatctgaggagactccggagcagggttctcaggaggactgcttcgtggatagtgctattcaagcattcagccaagcactcaagggtatgtgcatgcaaggaaactaccttaagataagggggaaataccccaagagctggcagtaacagtgttcggggctcacacaggcccaggaacacatccgggccctccaagatgactaagaagcctcgtgattccccaggaatttggtagagtacacagaagtgtaattttcctcagtactggaggaaaataagcccaaaattaagaagtgccttgatcacacttaatgttaaaatcaagaccccccccccaaagatcgtttgatctttccaaataaattaccttacccagaagaaggtaatacctaaaggattacaaaattatctagaagctggatgttagtggtgcacacctttgatcccagcactcaagagacagaggcaggtggatctctatgagtttgaggccagcctggtctacagagctagtttggagacagccaaggctacacagagaaaccctgtctctgaaaaccaaaaaccaaccaaccaaacaaacaaacaaacaaaaaatatctagcacttaactaatggaactcacatgtccaatatccaattttaaaaaaataaatcaggggccaggaaagatggtttagtgggtaaagacgatcacctttaagcctgataacctgagttcaatccctgggacccacatgacgggaggaaagtgactcctgcaagctgtcctctgacctccatctgtgtgctatggtatggtaacatgcacacacacaaacccagcttttacaggatgtctaaattgttaaaatatgctttatgtttcttttttgtttttgtttttttcaaaacaaggtttccctgtgtagcttggctgtcctggaactacctctgtagaccaggctggccttgaactcacagagatctgcttgcctctgcctccaaatgctgggattaaagacctgtatgttaccactgttcaatttaaaatatgctttttcttaaatggtgttttatttagagacagggcctcatgtagcccaagttggccacaaactcactaactcaggagtgctgagataacaggcgtggcctccatacctgatttatgtagtgctggagtccaagctaggttttgtgcatgagaggcaagtgcactatttactgaacaacatcctttgtccttaaaatgcaactttatctaaaggatttcctaaggtcaaaacttagtgcaacaatgtaaaacttgaacaaattctttgtgtctaaagaaacaaggctttctcaaaagtattgtccttgtttcagtgatatttacaaagaggaattagcttagaggacaagattttatgttttaagtcaattgcttgtgttttctgctgatttcatcaggtttttgactatggaggaaacaatattaacaaaaccaaggttcattcaaatatctacttctgttaaggtcttttaaataaccatttgaacaaacaactgactccaagcaattttatttatatattttatgtgtatgggtgttttgcctgatgtatgtctgtgtatcacatgtatgcctggtactgaggaagccagaagagggcacatgtgggtgctgggaattgaacctgggtcttctgtcagagtaattggtgcacttaaccgctgagccatgtctccagcctttgttttagtctttattacatttagtaagtgcacactacaggcgtttgtgtgcgcgcgcacacacacacacactcagtgcataatcgggggcagagaacaacttgtgggagttgactttctccttgcaccatatgggtggcaaggatcaaagtcagagcattagataaaggaattaatccgaagagccatatttctggccccttaggtgattttagtacatttaagaccctgtgtatctgtaatgtctaaagcaatatgtctaaaacctattctgaaaaactttgggaagttaaaggcacatgtttaatacatgtttaataccaaacagtgcagggctcactgttattgagtgtttatgttatatatcttagactgttgacacatgaaatggccttgaaattaaaaaaaaaaaaaaacaattctgctatttacaatcaggagcattaagataaaaacttgccttttatgctgagaatggtgactcaggcctgtactcccagcacttgggagttggaagcaggaaagtgatgagttcaaggtcatccttgactacatagtgagtttgaggccagctgggctacagtgaaaccctgtctcagaaaacaataacagctcaccaccgggcagtcttcctatttcaaccccagcctacttctgtttggcttgcctagtaggcatgttattattgagtatgtaaagtgtgtgtctgtgtttgttgtatgtcagataatgagcccgatatcacaggcactgcttcctaaatctgtaaaaggtccaaagttcttatttttgtctgcattggagacctattatcttacccagccaaagattccaaattttgtttcagaagtaggtaacacattaagaactcacgacagtagctgatcatggtgccacttgcctttagtcccagaacttaggaggcaggagcaggaggagctctattagttcaaggtcaacctgatctacaaagcaagtttcaggacaaccagagatacaaaaaatgaaaacctatctcaaacaaacgaaaaagaaaaacccacgatgctacttgtggctggcttctttatatggcaactgcctttatgctccccttgtattattggggtcttcaaacacgtggcccctcaaagcatcctttaccaaactgatgccttctaaactagaatcgttaagggtgataaccttgcctagctatcttagggttactattgctatgatgaaatgccatggccaaaagcaaactggggaggaaaggggttatttggcttacaattccacattactgttcatcataggaaaaagttaggataatttaaggagggcaggaaccaggaggctgggactgatacaaaagccatggagggttacttcttactagcttgttccttctagtttgctcagcctgatttattatagagcccaggaccaccagcccaggaatggctgggctgggtcctccacccatcaatcactaattaggaacatgatctacaagattgcctacagaacaatcttatagagatacttcctctcagatgactctagcttgtgtcaagttgacataaaacacactaaccttgcttctaaccaactatgcctatcatctttttgtatgtatgtatgtatgtatgtatgtatgtatgtatgtatgtatgtattaacaggcaaggtctccttcttcagccattttggactaggctggaactccatgtgtagcctaaattggcttcagacttatggagaccttcttcccacatcagcaagtactacaggcttcggctgtgtgctcagcatgactgtgctctttaagcaaagataactagacatgtcctaacacagtgtactctaagaagtgccccagtgacttttgtttgtttgtttgcttgcttgttcatttacactactaagaactgaacccagggcctcaaatatgccagatgagacctctctcactgactgtatcccagacccctccctttaacctcagctcaaggttcaggtcctgagacgggaaggggagtccatgcaaggaaaacttctgaccaccaagtggattgcactcaagtgtccccaaatatctcaggccatctttgtttacacttaaacaaagtttttcttaccaggattacatgaacagttttattattggcttctatttttgattttaagaaatacaacataatttaaggaatacatcatgatcgttatgaaagctcccattgttcccattatgcttcctcaaatacaccttcccaccccctacataaccttattctagacctagagttcagaatttttacaggcttaactaagtatcaagccagacacatcctactcttgcagtgcgcttatgtcagctggtagctacttgtggttacaaagttaaaaagtaatagacatagccacaatgctttaaggacaacaatattcaaacccagacaatttctccatgtctgcaatatatgctttcatgcagttcccttttctacaagagggtcccgtgtctcaatctctgtagaaggcagaccttgacagggcactctgttcctgtccctctatgccataattcttccaccagtgtaaactcctgtgtatggtaaagatagatctacccatccacactttgcattgtattgtttccccttccagcataccagatcccaccaatgattctatgtgtggtgtccagggaacatactctcaacggttggcactatgtgtattcctgagactttttccctattcagtgtatgcctgccctactctccagaactgtgaaacatggctaatgttccaagtgttgttttctcatatgtacctaacttctccattaagtaagaaaagttcccagggttaggagttgtagttagtaatttcagataagagatttgagaaagaatagccccctgttgaatctcaggagaaaatattcgagaaacagcagaatttccagggaaaattacagctattgcatggaggactgacaaagtaaaactaaaaaccacccaaagagggatggagagatagctcagaggttaagagacctggctgctcttccagagatcctgagttcagttcccagcacccacatggtggctcacagtcatccgtaatgctgccctcttctggcctgcagatacacatggaggcatctgggcagaatgttgtatatataataaataaaaccttttaaaaaatacccgagaaggattaaattgttaaaaaaaaaaaaaacaaagaatcagcaagagcttgcaagctgcacagattttgcaaattcctatgccaagtgagaatctgtttccataggtgccttgccccaaggaaactcgttggacaggtagtcccatgcttatccaagactaggctgcacagctcctgacacctcctcctgatggaaagacactggcatgtcatacatcctaaatcttgactacatctgtaagcaaatgcattctgctttatttggaaaacatgcttattctcaaagacaaaaataactaggggcttgtgggctaaatgtcacctagtattgaaaactcttgtcattctttagactgaaaaaaaattgagtgtatttctgaaagagagaaaaagttatgatggtcctaactaatgctgtcaatcataattattttcctgaaattctattcacaatgaaagtaactgcacagcatggttgatagccaaactttctgcaaaattctgaaatggctgttctgagtcttgtcaaccatagatgagatcccattggaacttatttatttattaatattattgtgtatgtgtgtatctgtgtatctgtgtatctgtgtgtgtgtctctgtgtgtgtatctgtgtgagtgtgtatgtatgtgtgtgtgagtgtgtgtgtgtggtgtatctgtgtgtgtgtgtgtggtgtatctgtgtgtgtgtgtgtggtgtatctgtgtgtgtgtgagagagtgtgtgtgtgtatgtgagtgtgtgtgtgtggtgtatctgtgtgtgtgtgtgtgtgtaaggacaaattcctccagttggttctctcctcccacctctctgcaggttccagacatccagtgcaagttgctcactgggccaacttactagccccttcatccatttctaaagaatttatggcaggggagccagttgctggtatcacacacctttaatcccagtactcaggaggcagaagcaggcagagccctgtgagtttgaggccatcctggtctcaaattgagttccaggacagccaggactattacacagagaaaccctgtcctaaaaaaccaaaaaagaaaaaaaaaattatgtccacgtttggtggtgctcacctttaatcccaacatgtagcaggcaggggatggcagatttctgtgagtttgaatctagtttagtctatataataagatccaggccagccaaaactacacagtgagaccctgtgtccaaaaaagaatttatgatcaaactcataaaaattactataacaagtacttatttttaaatctagtatttttgttgtcttgctttgttttgaggcatttcttgctgtataactctgggtggcctggaatttgctatgtaacatatctggccttgaacacttgatgactctgctctgactccttcctgactattggagttaacaggagtgtactgctgtgcctggtacaaagctgcattcttaaaaaatgttagggctggtgatatggctcagtgggtgaagatgcttgttgtcaagtctgacagcctgtgttcaatccccaggtcccacgtggtgtaaaagaacagtcttggaagttgtcctctgacctctacacatctgccattgtacacaagccgtgtactcgaatcatgagcacgagtatgtgcacacacactcacatgcacacacacacatcccttaatagtaaataaaatacatatttctaaaaaatgtatttatttttatgtgcatcggtgttttgtctgcaggtatctctgtgtgagagtttcaggtctcctggaactggaattacagatagttgtgagctaccatgtggatgctgggaatcgaacctggagcctctggaagagtagtcagtgctcttaacccctgagccatctatctccagccccaaaatatatactttcttgaaacagagtttcactatgtagccctgattggcctacaagttgctatatgatgtataattttggatgttcatgtaatattgggaattgaatgcaggtccttgtgcattctagacccgtctaccactcagctgtgtcccattggagattttagtaagctttcacaaatcaccatatgcgtatttcctggcttttgcctcgccttccctatgaacttgccccttttccataatattgtgctggtactccatgcttgttgcagaattatttgtttacattgtaaagatgtgtctctgcctaagatgccttctgattggtgtaataaagagctgaatggccaatagctaggcaggagagactaggtgggacctctggagaaggagagaaagaggaggaggaatttaggcatgcagattttgccagcagactcagagcaagtcagacatgccatactgacgagaggtaattgaaccatgtggcagaatgtagattaaaaatatggattaattaagttataagagctagttagaaacaagcctaagctaaaggccaagctttcataattattaataaatctccatgttgttatttgggggctggcgatccaaagataatctaacaaaaaacaaacaaacaaacaaaaaacttggtatacatgatggaatgaaagtaggactctctctctccattttgggtaagctataaataaatccattttctttattagtttgcttttttcatttcttttaaggtacactgggtatttatacctacaataatacgaagcaggaaataacaatgaaaattaattaaaaccaatccagaaatggaagtttgaatcagcaaacaaggatgttaaagcaatggtcataactatagtatatattacccaaagttaagcaaacacatagaagatataaaagaagtcaaaactctagagatgagtgagagtaaaaacagactggagacaggagagatgacttggaggttaagaacgctgattgctcttgcagaggacctgggttcaattcccaagcacccacttggcagtttatagctgcctgtcactccagtcccaggaaatccaatgtcatcttttagcatccatgggcactaggcatgaacaaggatcacagatgtacattcaaacaagcactcatacataaattaaattaaaatgaataaactctcaaaataaaatcacggatggtactgcccacatttaagatgggtcacctcagaaatccttagagacacatcagaggttggtcttctctattattctaagtcctgtcagtctgaaaatctatatataccatcacaccactggagggttcacaattggcataatagctgctgagacagggtttctctgtgtagccctaaccaggctggcctcaaacttacagagatacactttgctctgctggggttaaaggcatgtattccccccccccattttcttttcttaaatttaaagtgtatgagtgttttgcttgtgtgcatgtctgtgcatcatgggcatgcatagtacaaacagaggccataagaaaatttcagagctcctaagactgaagttacagggagagatgaaccatcaagtaggtgctgagaattgaaccccagtaggttggaaaaacagacagagctatttaactactgagccatttttccagctccatttatcattttcttaatggtgacagattctctatccacctgttatctatcatctatctgtccgtctgtctgtctgactgcctgtctgcctgtgtgtatgagaaagcgagtgcttgatgcctgtgggtgtgcacatacatatgtgtgtgaatgtggagaaaagaaatcagtctcaggaatgctacccaccctcctattgtggagtgtggtgtatgtgtctgtatgtgtgggtatgcacatctttgacttgcagaggtcagaagaggacattggtcaacaggcattatcagtctctattcctttttaagacagaatgaattgctcactgaacccaaagggaggccgatggccctcaggccccagctatcctcctgtctccacccctcacagcagtggggttacaggggagcctgaggccaagtctgactttatgtgtttgttctgggatatgaactcaggtcccctgcttggagggcaatcactttactgagccatctccccctccttatgggtctgattgaacccgggtcattgtctaccttagtctggtgttctaacacaaaccacagttccagctcttttttgtttgtttgtttgtttgtttgtttttgttttttgagacagggtttctctatgtagctttggagcctatcctggcacttgctctggagaccaggctggcctcgaactcacagagatccgcctgcctccgcctcccgagtgctgggattaaaggcatgtgccaccaacgcccggccagttccagctcttaatgatgtcttctatttaatcaaactgaaacccatataatgtaaaattgagcatttaagtgaacaattcactgtctttttaaaactaaaagatttaatttaatttaattttattttattcatgttttgcccacattcatgtctttgtgagggtgttggatcccctgaagctagagttacagacagttgtgagttgccatgtgggtgctgggaattgaacccaggtcctctggaagagtagccaatgctcttaaccactaaaccatctctccatttcattgtcttttcttttttttaggtaaggtctcatatagctcaggctggcttctgaactcactaaatgtagccgagattgaccacaagcttttttctttttgagacagggtttctcaatgtaacagtcttggctgtcctggaacttgttctgtagaccaggatgtcctcaaactcacagagatctgcttgcctctacctctcaagtgctgggctgaccaccaacttgtgatctgtctacttctgcctcctgagtggtgggattacagacatgcactatcacatgtggtttatatggagctgggtactaaggcttcatgaatgttaggcaagcactctgttaactgagctaaatgtctagcccaaaggtttgtatttttgaggtatggtttcacatagttgaggcttgtcttgagctgaccctccctttccacctctcaagagctgatattataggcatgtgccaccatcacaggttttatcatggaaaatgttataggaagttttgtatttttcttttttcatcgtggggaattagatccaggatctcattaatgctaaggacatgctcttccaatgagcttacatccgcagcagtaaagattttatatgttcattcatggcttgatgtaaaatcatcttgtgcatatccacctttgcacaactccttaaaagacactggcttaacctggtggagtgagaggactctagaattgggagggccagccctactactgatagtcatcagctgatctcgagttagctggctgactgttctgggacgcagcctttttattgcacccttggacctaccctgtgctttgccttctggtttcatctttcccatgagcctaagaggtatgcaagataccaccactagtcctccttcacagatgaagaaacagtctgaatgcagctgactagaccagttgaccttgtgggacctgtctcctctccacccaagcctagagactcccctgggatttagcagaaagctttctcattgcaccctgtaccacctgcagagacgtctgcgtgtaccagggtgagctctaagattccggggagtctttctgtctgacaccttcccagcttatgtaaagtgacctggatgcttgctgcttgattctatctttgcctgaagaatttttaggtgtgactttagtctgcatttttgttgttgttgctgttgctactgcctcttctttggattgcagattctggtttaggacagacatctccagtgagcattctagggaaagaaaatattctggtttgcaatgtatagaggttggtcactggaggtttcacaggctaaagctaacattaagtttgaaagcaaaaaaggagaaaacttgtgggggctgtaccaggattcccacccccaacacttcactatgaaagcatttaaacaggtagaactgtatacaatggaaagactgaataacaaatacacttagattctatatttatcaactgattgctgtttgctctgtcacacattcgtttattgacccctcattgtctctgcccattcatctcaattttttgacaacttcaatgaagctgtagagttcactccacctctaagcactgtagcatgactatcattaactagcattcaatgtttggctttgcttatgttaaataatatacaaagcagacattgttttagattgagctcctaaactaggcccaacagatcaaaccaaaactaactcatcctaaattgtaagtctcttttttgatgtttttgtttttggagacatggtttctctgtatagccctggctgtcctggaactacctttgtaaaccaggctggtttccaacacacagaaacccgcttgcctctgcaagagattaaaggcatgtgccaccactacctggctaaatctccgattattaattgttatggtaaaagcttcaccctagagcctgccacccatatacccaaagagtctggaatgttatgttgggagctccacccaagcccctcctctatctctctccaaaccctgctacatctcagaaagccggacaaatgatgacccttcccccagatatactcaaaaccactcccacagggtatttaaactaccacccagaaaacagattgctggtttttctggtctccctttcctgtctcctctttcgaggactggaaggctatccaggaccatagtatccattaaacttgggctttttctttctttctttctttctttctttctttctttttaagatttatttatttatttatttatcatgtatacagtgtgtgccagaagaggacaccagatcacattacagatggttgtgagtcaccatgtggttgctgggaattgaactcagaacctctggaagaacagtcagtgctcttaacccctgagccatctctccagcccctctttcttttttaataatttttttcatttagaaacaatgttattttacatatcaatccctccttccctctccctcccatccttccaagcccttcaccgacccccccaacctacccccacccactccctaaggatagtgagacattccatgggggatcataaaagtctgtcacatcattttggagaggccctcctttgtgtatctgggctgaaacagtatccctccataaggaatgggctcccaaaatccattggtgcacaagggataaatactggttcatgtgggctttttctaattcggtttgatttggtctgatttggattgctgcatcggcggagaggcttgtggggtatagaaacttttcattaatgtttacaagaaaagtaattttgaagtgattagctcaccttccaatcactgtttctgctttctctagccacttgccttgggccattgacatggctagcaggtaaaatcacttgttttgcaagcctgatgatctgagtttgagcctggaaaaccacctaagacattggatatgatggtatacatctgtaatcccggctctcctttggtgagatgggaggcagaggttggagaacccggaacctctcaggccagtagcttcaggtatgtagcatagaaagtctcagacttctaaacttgctttagtttttccagtgataaccccatcccagagctacctaggggccgccagccatcagttgactcaacatacatgaagacacttcttacttgggaggatttgagaatttttagaaactgcatgtcagaaatcaggacatatcaatatctgtcatctatctacctacctacctacctacctgttatttatgtaccctctacctattttccatttatctgtctttgtatgtatgtacgtatgttttatgtatctatcacctgtctgtctgtctgactgttcttcctgttggcctacctacctacagacccacctatcatctttgtatgtatgtatgtatgtttgtatgtatctatcacctgtctgtctgtcctacctacagacccacctatcatctttcacaccatcctactttgtactgtcacaattcattctttctttttgcttacttgtattccattgtctggatgaatatttgacagttcattaattctcctgtataaaacatcaccttggattggtttccagtattttctttttaatttttttttgtgttttggttttatttatttttattttttgtttgttttagttttaggggacttggtttttcaagacagggtgtctctgtgtaaccctgactgtcctgggactcactttgtagaccaggctgaactcaaacacagagatgcacctgtctctgccttctgagtgctgggattaaaggcatgtgccaccattgcctggcttctttttaatttgtaaagattggttgtcatttatttatgtgtgcgtgtatctgtgtgttaatattcccacaagcattcagtgcccaaggaggcctgaagaaggcattgggtcccttggtaccagagttatagacacttgcaaatatttgatgttggtgatgtaactgaattgagatcctctgaaagagcaggaaatgcttttaactgctatgatgtctctccagctcctattttaaaattttttattggagacagggtctcactgtgtaacccagactggcctcaaattcacttttgccgtgtgtgtgtgtgtgtgtgtgtgtgtgtgtgtgtgtgtgtggtgtaggccagatgacaactacgaatataagtccttgcctttcactttgtttgagacagggtttctcctttgctattgtgtaggccaggctgacctttgagattctgggcattctcctgtgtctgcctctcattttggcattggaatgttgcactatcttgctctaaagaccaggctgtcctcgaattcacagagatgggcctgcctctgccttctgagtgctggaattaaaggtgtgagccactgcctcctggctccacctctgcctggcttaccctgtctatctttatgtgaattcttagaagctgaacttatgccttggagcaagtgctttcctcattgagtatctccccactgaccatgagcttctgcctcctgactccatctccttggtgttgggattaaaggtgtatgtctccctgttgttttgttgtttgctttttgttttgagacaggtatttctctatatccctgtctggcctggtactcataatgcagtttaggctggccatcagcttgcaagaatcctcctgcctcagccttccaagtgctagcaaggcctgacagtttttgtattttacttgtgttagctaatttaatccccaataatactaaatgcagatgcattactattcccatcttatagctgaggaaaccgaccacctactgaggttggaatacaagtttaatgacatagtacatgtgaaattcttagggcaagatttagtgattacaatgtaagaagtgtatgttagtgattacagtgcagagtaaccattaggaaatttttattttacttacttggtctttatatttactacccttgattattagtaggaagcaaagttgccaaataccatataggatgcccagttaaatttgaatttttggaattaaggagcaagagggagggcagtagagaagtgaataaaaacaaaatattgtgatatatatatatatatatatatctgcatgccgcaataaaatactgtactttgtatgctacctacaagttaattatggccagagagctgactcatctggtaaaggcacttgtcaccaagcctgactgaagttcagtccctgggaaccatgtgatgggaagagaaaagcaactcctgcaaagctgtcctctgacctccacacacagcatggcttgacatacacaataaattactaaatgtaattacaattttaaaataaaataaaaatattttaaatttttaaaagttttgaatattagccaggtgtggtagcacacgcctttaatttcagcacttgggaggcagggacaggtaaatctctatgagttcaaggcccatttggtctacacagtgagttctaggccagccagggctgcacagtaaaaccctatctcaaacatttttttttttgtatcctagataatgaaaaacaaatagcgtaagtcagtcacatgcaattttgactgtaaaaatatgagtgtggtgacggtagcatacacctttaattccagcctttctctgtgtagcctgtcccggaactccctctggagaccaggctgacctcaaactcacagagatgcccctgcctctgcctcccaagtgctgggattaagggggtttgagtggtttcaatgcaggttttaaacaggagggttctgaggaggaaggagcttgtgaaagaaataggatacttggggagaacatgggcttgggctgctcaataactgtgtatacagcattctggaggcctttgaagctattgtctttaaagtgttgctaaagaatgagatgctaatgagatgacagtgtggttcctgggcccatctgacagggggacaattgataaggaaaaaaatctagatcacaggaatgcaggttagaagatatttattgtaagcaaggtgaacagccttgcttgtgggtttcccagaaagtgtctgggagaagaacgagagacccttccaaggtcatatgctttcaggcctggagcttggttcatctttattttaacataaaatatctataaacaaaagaaatatctttgtatttgcaaccttctcagtaaacactgttaattgtgcttgacttctcagctgtcgagagacttcaacctcattctgtggaaggtcttagttttcttctctggtcctcaggatttcccttgtcttttatctgactcaggagcaaagatagaacctgtataattcattctgcagatgtggaaacagcctcaaagaaaggaaatgatgtagctatagccttaggtgtcccccttcacacactccagggtcccaggtagctgaggctcacctggagctcagcatgtggctgaggatggccataaactcctggttctggtatcatctttaccctctctggtgctgggattacagggatatgccaacatgcccagcaaaaggctgagtttcagtgttttagtgtgtgtgtgtgtgtgtgtgtgtgtgtgtgtgtgtgtgtgtgtgtggatgcttgtgtatcaagatgcaccatatgtggaaatcaggacactttgtaggagtttgttctcttttctcctaggcatttaatttaggtgattagaaatttgtaggcagaagtttctgtccttcacgctgatctcaaataaccacacagaggcttaatactataaatgcttagccaatagctcaggcttattactagctaacacttacattttcaatgaacccatatttttatctatgctttgccttgtagcttggtaccttttctcatttcagcatgtccatcttgcttctctctgtttctgcttgctactcctctgactccacccttttttccaacattctcagattggctttcccacctaactttatcctgttcagctattggccagtcagcttctttattaaaccaactacagtgacatgtattcacacagtgaaaggaacatcctacatttccccctatttgcctaattaaaaaagaaggctttaactttaacatattaagattatatacaacaaaacatttattaagtaagaattatagttacaatatagttcatttgtatttggcaaaattagagaaaatattctattatctattttatctttgtgatatacctaattatacctaatttatcatctcatggccccgcctccactcttttattttcacagatgaggtctaatgtacctcaggctgtcctcaaattccctatgtagtagccaaggatggcttttttttgtttgtttgtttgtttgtttttttttgttttttgtttttttgagacagggtttctctgtgtagctttgaagcctatcctggcactcactctggagaccagtctggccttgaactcacagagatccacctgcctctgactcccgagtgctgggattaaaggtgtgtgccaccaacgccgggctcaaggatggttttgaagagatcatcctcactgctgggattacaggcatctactgttactcatggtttatgtggtacaaagaatgaaagaagcccagggctgcatgcatgcaaggcatgcactctaccaactgaactacaaccgaaggtccccagcccatctcagctctctgaagccctatcaagcatctgtctccattaacacagctattcaagccttccctgtctgtggcaattaaaagtggagcaaatccatgacagagagggacagcagcatgactaagtgttctgttgggagagccagtaagggacaggtggcatgtgggccagtggggtgtctttttcaactcctttctgaaatgggtttctgtctctcccctcttccttctcccctcttttcctttctccacttctctcccctttgtcctctttttactcttcctcctcactctcctctgtcttctcccccttctattatttgaggcagggtcttatgttcctcaagctgtcctcaagctcactatgtagccaaggaagaccataagctcttgatcctcttgcctccatcttccaagtgcaggtatactgacatgtagccccacgtgcatctgggtaccaccttcccttgcttatagccagctctttcagacttcaaggttttgctgcacaagggcttttgttcctggctaacctggtgtcctagacagaaggaaaatgaaagtggtttgaggttttattagccactgtttctgcattttaattttttcagtcaggccaagactgaggtagttctgactcaagaaaactgagagccagaaccacacagtgtgaaagaatgaggaaatgacctagctgtgatttgctgccttggccaacacagcttcttggagaaccaccaagtacctattttatatctgcctgaatcttcacaatatcctgggaggtgggcttgtaaccattctggcaggaatgaagacatcaaaagagatacgtgtgcctgttcctacagctattgttgtttgctattgggacaaggaccccaagaaattagaatcttcccacgagtctcattctggtgaagggaaaggccttggagccaggcagaagagaactttctcccaaaaaagatgccacaaagttctgataatttaaatttcaagagagactggagcccaaacaatgacctcaccttatccacgaccacttagctatgcataccccttgctctctatgtaaccctaagccttgtgtcaggaccctaaatttggacttgaggggttcactggacctctttgttgctcttctcaatgtgttcatagtgcatcaaatctctttattctgcgtgtcaatattactttgtctcttttgttggctttttgggggatagatgggcaagtccagcttgtcagcactgtcgggccctggctctgacactcacatctctgttgcaggatctaatattttcgtatggtgatttggttatgggggctcagatgaccgtgtctgtgacttagaaagcaaagtgacattggctgctcacttgagtgtctcccttggctcagttactttttgttcccctccctttgctggctatttgaaattctcattctaaatccccagttttacttggattaagacgataactgttaagtaatcttactgtagatttacagaaccttgacctgcatataacataagaatgtgtacttcctcccattccatattctttgattctgggcatcagataacataaaacatataagttgctatgatgtttaacttgtagaaagtagtttttgttctaggaggcctgcccattgccacttcccctctttccctttcttataaaagccgtctgttgggctggggagatagcttagtaggtagaatgcttactgcacgagtgtgaggttatgattcccagcacccatgtgaaaaactggccttggtggcacacacctgtaatcccagcactggggaggccgataggggagaatcctggggtttgttggccagacagactagctgagtcagtgagagcttggtttagtaagtgaccctatctcagaaagtagtgattgaggaggacacttggcaccaacctctgcccactgtgccccctcctcaaagacacacagacaaacagacagacagacacatatgcatacacacacacacacacacacacacacacacacacacaccacaatttgtgccctcaagtttcctgagatgaggttctgaggcaataggccccatctcctcaggacaccagtctctgaataaagctgactccctgtttacccagtctcccacctctagaggagggctggcattcagtggcaagcagttggacatgggttcagtaacagcaagttattggtagaaggattggatttttatgtttctctgaagtcctcattactaattcttggcattcctgcctcataaatcagggatagtttgccctgttgacactggcaagaagcttaaggcagcacagttcaatggtcacaaaatatgacttctgggggtcagcatcacctggaaatgtgttagaaatgcccattcctggcctcattctagaacttttaagaacctctaggggttgggtacagctgaaggacacagcatacacctagcatgtgcatctcctacataaaattcccagaacaataatttttaaaaaagacattcttggggaaggtttagagtatagtttttgatttccaacaccttagttttacctactatgatagaatcttaaaattatgggtctggccaagtaacctacaaatctgacttcttgagttccattcttgcttgatacctggatcccacaatgggaggagagagctagttcctgaaagttgtcttcttacctccacactaataataatcaataaaacagaattgaaaataaacatgcagacacattgagtgtggtaatacatgcttgtaatcagtcccagtactgggaagtttgggggtgaagaagcctgggtttgaggccagcttcagctacatagtgaaaatttgtcccccaaataaagaaaagttgtagataaagactgtctggaaggagatggtttggctcttttcttagtgttcttgggccagttggcaatttcctttatactcggtttttttctctctctctgtataaagtaataaaacacttaatattttatagtatgcctggtgactagaatcatctaggatgctagttagaaagcccagattcccctagagcacaccactctctcaatactgggaatagaatcttgggcctcatcaatgctaggcaagtgctctaccagtgaacaacatccctaccttacaacataattcccaacagggcaaacattggttggaagagcagaagacttttaaatacttcaaaaccaaaccaaacaccctaaaacccagggttttaccatgtaacccctagaactctctttttagacctggctaactgtgcacttccagagatccagctgtctttgtcttctcactgaacctgaaagcttgctgtgtggtcttggctggttaactagggagctcctatctctgcccccagggctggggttgggggagtctatgtctgcttttacatggaccctggggattcaattcaagtccttgtgcttgcgggcaaatgctcttacctactgagccatcttcccaacccagaattttttttaataaactctcctagcacataatggagaatatgatagtttcaaaggtgctcaaaaaagtgtaagtgactggatagatggtttccttgcgagaccaaacaatagtggcaaagatgggtaattaccaagtgcttgagtagtgcctctgtttgcacagcctattaatcctcacaaacacttccaagggaggttgaggataggcttcgatggatttgcctgggtttcttatcctacatacagcttaatttaagcatctgaaaaaggtaacaaatggcgtttttctcatagttttgtggtaaggatccagaagtatgcttttcatttttttttttttagaactcctgccactgtcaagctgtcaccctcccaagaacaccctgtcaaaaaggtggagaaaagagaatttgaacccaatcagtgtaatcccagaaagatagaactggctcagtgattgcggaattgtgatccctgctgtcagtagtatcgctagggaacttgttaaaaatgcaaattataaaacactccccaccccatcccagatccactgagtcagaaactggcggtgggggctcaaaagtctgtttttcaaagctgttcgaggaattctaaggcacgctagagtttgggaacagtctttagaggttttggcgggggtggggagtgggagtggggtagggtggggtagagggtggtgaggagaagtgttaaaaaaaggaagaaaggaatgaaaaaaggaagaagggaagaaaaagaaggaagaaaattaaaaacaaaacaaaacaaaaacaaaaactctggagatgtggagactgggtccacttcacctgaaggtgaggaaaatgctgtagcaggctggcgcgcaagggctgctggggtctgtagtcccgactgcgccttaggggacgcgcctgcgcactggttgcgagctcgctctagtcgctgtagtcggggctcgggaccggctgccatcgtagtggagggactgaggagtcgtcgccgccccgagtcccggtaaacacccgcgggccgactggggggcagctctgtggttaggagggagcttggcatgggggaaggcacggagagtgcgaagggtagaagagtgcggcgcgcgagtcggaacccagagccgaggctgctcttcgcgcagccggtgtccgtggggggcgcccggagctccggctggtggcccgagccgggcggagggtgggtcagcgggacgagccgggctgctagtgcctggcgcaggcgcccggagcccgtggccccgcgaaccccaagttggaagagagccgagccgaggcggacgtgggcagggtccagcgccgcgccccgctgtcgcgccggggggctccgctcccgcggctcggcctacgcgcggggcccggtggcagcggcccgcccgagcgacgtggccctttgaggggcggcggccgggcccacctgccacctggcaagctctcccgagacttttccaggctcccactcgcggaggaccttcttccgtagcctgcctccccttctagtctttcactcccctcctcctcccattgtccccactcatggtggtctcggcccaggccggcgccgccgacttttgcggacgtggagctgtcactgtctttcctttcaagagcgtacttttctttagcaaagaaaaaagtagaggtgagcgtatgtgaagggtcgaagcctcgaagacatggctttaaagtagaagactcgagttttcagacatggttctctgggctgcaacttcaaaagaggaaaataagggtcagtgcacccgaggtaggcattgggcctaaagttaggtctgtgaccaggtgaactttcgcagtacccgaagctgacggttccccagtcacttgtttttcttggttgtgttagaatcctcctaatcttgaattttctgcttcgctctagctgttgtagtgaacttggctgaagggaggagtgtggagaaaagagtgaagagttttggtttttttcccttcaaagttacagaacacaacctagccacccatcattgtgctcttaagtgtgctgcttctcctggatcggtgagatcttatgaaaataggtaaaggccatgtgtgttcactctcagggttggcaactggtttggttctcatctgaaataaagtttttttctggggggcggtggcaaatttgatgagattcagccttgcatatcacaggtttacttaaggcttaatttttccgggttttagaaaagatgcaattctccttgaatagttagtgtactttgtgtgtgagctcatgaattcagactttagaatagacctcaacaaggatataatgtgaaaccaaaagcatgtattctagagttgtttttattttattttgagacaagatcttgctgtatagctctggaatacactgtgtaaacttagactggcatcccacttaattgtatcttcctgtctctgcctcctgagtgcttcagttacaggtacatgccaacacgataggcacaggagaaattttagatttgttgatttgtgtgtgtgagcgccatgactcgagttggaggtcagaaggtaaccctcaagagtgtttcctccttttaccctgtggcttccagggatcaaactcagatcaacaggcttgcatagcaaatgcctttacttaatgatctattctgctgaaccagaattttttttggggggcgggggtggacagagtttctctgtatagccctggctgtcctggaactcactctgtatggagacagagatccctcccaggtgctgggattaaaggccttcactaccactgcacagttcaggagagatttttttgttttgttttgttttttgttttttgttttgttttgtttttggagacaaggtttctctgtgtagctttggagcctttcctggcactcgctctggagaccaggctggcctcgaactcagagatctgcctgcttctgcctcccaagtgctgggattaaaggcaagcaccaccaatgcctggcccaggagagatttttaaaagtagagtgtgcagctcagttgttagagtgcttgcttaccatatacaaaccacagaatttaagtctcagtaattgggaggtgaggccaatgctacttgagacccttttggaaaaaaagggagatgttctcaggtttcatttttgagattgatttgtagttcagaattggtttctaccagtttatttgaaaatctgtctcaggtagttgggtagtcttgggagctactgaggtaaacaatagtatggctataccaaggacagctcaaaaagctttgagatagaaaaggaagtggaagtgactagtgtgggaattattgaaggaagtggcaggactggtctctgaaggctaggcttagtggcgtaccaactcaaggtcagcctggtcaacatagtgagttccaggcccgccagagctacatagtgagacccagtcttaaacaaaaaaaaaaaattgcctatcgtctgagttctgcctagagcattggttttcaacccctttgacaaacgtctatcttcacaaaactttacagtagcaaagttacagttatgaagtagcaaaaacagttttatggtgtgtgtgtgggggtcagcacgacatgaggaactgtgttaaaggattgcagcattatgaaggttaagaaccactgctctaaaggataagtagcaatgtggcagaggcgaggaaagggaaggcagtgcagaaaggaaatactcaaggctgtgtgtcaatgagaccgaatgtgggagaaaaagagttcagtgagcaggaagcagagaggaggacagcattgtgggactcaaggccagaaaggtaaaaggagctgattctagaaaacttctgtgtatagttttgaattttatgttgttagagataaaggtttttgggaaaggcagtgatgtgagttggtgcttgttttaaaaagatggctctgggataaaagtgaaagggtgaaagtgactgttgcagaagtctcccttataagtgacagaggctggccttggaggtgggactaaggggttgccatgttttttgataggattgttttagggctggtctggttaaagggttccttttctctaaggatatagtcattagcatctttgagaaataagagctagatcagatgcaatctggaagtgagcttgagttttggactatgtgactgtcaacacatcaatccatgtttgctcaatgtgttttccttctagtcacagaaacttggtacttgagttttacagttggaagagattgtctactgtatagtggcaaatatgttttaggttgcaggccaactttggttggaaatagcttctggaagtacttactgttaaggaggatccgggcaatctatgcttcagtgtgaggtcctcaccctccaccccacccccaccaaaaagagtggattctggttgtattagttccctggggaagtatgctatgatttaggactgatatctctagtgaatagttatctagtaggtagtctgtgtgtgtgtgcttgcacacacatgcacacaccacgtacatactattacactggcccagtctcttagctttctgtttctgtttttgatgacagggtctcagtttgcagactaggctggtcttgagctcgcagagatccatctgtgtggcctacatagctagttccaggtgagctagatgtatgtagtgagagcttgtctcaaaagaagaaaaagatgttttgcctaaaactagttttagtcagaactagaaccaaatgctgtaactctggtactctccagtttaccgaagtgagtgtattgccactgtacaaatgttgtcatagtaggaaaaaaaatacttctacctatgcctatttactgtatagacaagatattaatgaattttcacctagaaaggagtttagtttactccttttgactcaggaagttgagttagtactaacaggaaactgccagtctcaaggctcccttcctttcttgtgccttacctctcttagtttggggattggttataagaactaaggtaaaagtatttaagtttgttttttctttctgtatttatagtgcttagcaaattatggttcataaaaagcattcagtaaagacatgctaacttttgtgctgtaaatgatactgatgttgagtcagtatagatcagtaaagggccttccctgatgtggtgccctcatctgaaaatattaagttgcagcttttttttggggggggggggtttcgagacagggtttctctgtgtagctttggagcctatcctggcactcgctctggagaacaggctggccttgaaatcacagagctccacctgcctctgcctcccaagtgctgggattaaaggcatgcgccaccaatgcctggcatgagtagtagttctaatgagaagctgcccctggccctgccctcctcctcctccagtctagtagtgaccattgttggagagctgctgccaggttgactctattgctgctttttaactcagagtctcagtgcttcccccagcctgtgtctctaggagcttctgacttgtaggaatccactttacagtgacccttatggagagaatatgtgtatgtatgttatccttagtttgcaaatgtccatcatatccaagtggattttatcccatactgtgcaggagtcatttcctcagaagttttatcttctctgttctgtataaaatgtctttcttgtagattcttctttttgggggggtgggaggctttatgctgggcaaataaagacactttttttctttttggagtttcccaaggttatcacagatctgtttaaccagagtactttgttaatggacccttcttctctttcaggtaacatgcatttcacagtggccttctggaaacaacgccttaacccaaagaagtgactcaaccagtgagaatttcaggtgtggtgacattcctgtgagagacatttgggggcagtatggagcagagggcaagtcctggtcacataactgctgtgaagagctgtgtgggagaggatgttagttactggttacatcaattggcttttcccacttgtgctgtgttataaatatttatcttcttaaacatgttcaaacatatacatgtgatggttaagaagtggagaaattgctgggtggtggtggcacacacctttaatcccagcgctcagaaggcaaaggcaggtggatctctaagttcaagaccagcgtggtctacagaatgagttccaagacagccagggatatacagagaaaccctgtctatagggagggaaaaaagtagaagaattcgtaagaatgcagcatagtatagtgtagaaaacagaaagatctgggctctgattttgcactgacagtctgtgttacttttggtaattttcttaattctgctggcctcaggttatctatcttctatatagatatattgattcttttctacctccctggggttattgtgaggaccaaataaaacaatacatattaaatcttcagaatcgaaaataaggggctggagatttagttcacttgcttgcctaacatgcatgaagccctaaattcaatccctagtgatgaattaattgggtgtagtggcacaagcctcttatctcaggaccatcagcagttcaaggttgtctttggctacataatgaatttgaggccatcctgggttacatgagaccttgtctgaaaaaaaggaaagtaagaaaatgaatttatagtttaagacatctagatctataagataggatcagttgatactattattataaggaaaacattacaagatagactcattttaagaggccaagaaaggggctggagagatggctcagaggttaagaacactggctgttcttctagaagtcctgagttcaattcccagcaaccacatggtgactcacaaccatctataatgagatctggtgccctcatggcatgcagacatatctgcaagaagaacactgtataccttataaagaaataaatctttaaaaaaaaattgaaaaaaaaaaagaggtcaagaaagagtagagctgtgtggatagttgcacaagcctttaattccagaggtagaggcagttagatctctgtgaatttgaaaatagactggttacatggcaagctccagatcaaccagtatgacatagatagaccctgtctctttaaaaacaaaacagcagagaaagattagtgggccgggggagatggaaacacacacacacacacactgaagtattgcatgtgaaactgaactattaggtgaggaaactgaaaggaattatagtcactacctctgagaaataccttcattgctataggtttattgcagtattattatttaccatagccaagataatagaaacataaacatgtctgttgataggtaaatgggtaaatgtgaactatatttatattttacacacacacacagtgatgtatatgtgtaataggaagtactacttggccttgaaatagaaggaaatctgtccatttgggatagcatagatgaatctgaaggacattatgtcaggtaaattagtgcacagacagatgtaccatctcacttatatatagactaaagtcacttttagaaatggagagaagggtgctaccaagaattagatacagaaaatggggagatgttagtcaaaggatacaaacttagaaaatgaataaaatttgaaaacctgttgggcatagtggctaataactaatcccagctcttgtaagactaaattaggaagcttgtgaatttgaggttagcctgggctatttggcagtgctttctttccccttatcctcttcaaaacccagtaataataagagacttgaaattcactgtaagagtaaaatttgagctgtggaagtggcttgtgtggtatagtgtctgcttacaagcatgaggacctgagtttgggtcaccagaacccacctagaagctatgaacagtggcatgtgcctataaccacctccctccccccaaactggggagtgtggaccagggagacaaatttctaaactcattcgatagtctgcctagaagaatcagtgagagacagaccctgtctcaaaaactaaagatgtaaaactgaggagagagctgggcagttgcttatggagctaaagccatgtagctgtgttaaatgtgccctcttctctgagtccttcctttttgtcttatctccttctaaagcatgcttttccttccttccttccttccttccttccttccttccttccttcttttttttaagttacaattccctcctcgattttatccatgctgttgattgtccaccacatgtctaacctccattgctgaacatgttggtttaaatggcatggcttttctcttcctctttgtcatttcccttttgacagatgctgaagtttgcagcttgttctgggatttttctttttaaattctaataaaattacccttaggcttaaagatagaaagcaagcaagctgacatctgtctacctctagccgctatactcatgtacacaaagtacatatatcatataccacatgcgcgcgcgcgcgcacacacacacacacacacacacacacacacacacacggggggggggggagcgctaccagtgagatggggcagcaagtaataagcacttgttgaacaacctgatgacctgagttagattcctagaacccatggtggaaggagagaactgactccgagaaattgtcctctgaccatcttatgcacacccacactcacacatattcatgcacaatgataatactttttttaaatagaaaagctgggtgttgtaacatactccttcctttaatcccagcacatggaaggcagacgctggcagatttttgtgagttcaaggtctacatagtgttctaggacagccaaagcaggaggatctagagtgtaaggttatccttgtatcatagcaatttgaggtagtctggactacccaagaccttgtctcaaaaagacacacatacacacccaaaaagaaaaaaaaaaaaggaaagaaaggaagaaggaaagagagaaagaagagaatggaaaagaaaatcgtttcctgaggatcagtgcccgaccataaacttgaggctattagttgccagtcaccatcatcaccatgtctttgcaaactcattcatcctttgtctccactgtgagcattaatgtttatcattctctcaccttttgatttagtttgtgtttgtgttaactagttgccctataaatgcttaagacagaacaaggctttgattggcttatgtaaaggagtctcatttgctataatcagatgcttgcttaactgtgctttttttgatagtcatggagagaaaggaaggagatggtgatgtgatttgtgaaagataatagaaaggaaatgagtacaagggagagcagttaagtgagattgcaaagaagttgtttcagattgttagaaggcatgaaaatgaaatatgtacacttcataagaagctgttatctgcaataaagaagcaaatcagcttccattccttcaatgatggcctatcttaccagaaataaagaaatttcctcaaaaagaaatgtattggaaaagattgtttctgtttccaaatattttcaaaatgttcctcagagtagccatttcaccccagttcccaaagcagttctttttggagagatacctgcgagacttgtgttgtagtttttatattctgtaatcttgggcagctgatttaaatctctcagagttttatatcccccccacccctcaaaaaaaaaaaaaaagatagggtagctgaagctggccttaaactcactgtagctaaggactatcttgaaatttgattctcccaagtgctgggattccaagggtgcccccctccatccctgtctactgaaagtttgcctgtgtcctctcagatgccttcttttccagtctctgattatactttgtgtttcatgtgctgagtcactacttttggtgttttgaagacagggtttctcagtgtagctttgtagaccaggctggccttgaactcatagagatttgcctgcctctgcctcctgagtgctgggattaaaggcatgcgccaccaccgcttggctgagttacttactacctttttagtgctttgttttcctcatggtataggactaatatcagtaacataagattttctagtatttactgttttacaaatgagaagccagagccagctgtaatcctagcacttggaggtagaggcaggtggatatctctgagtttgaggctagcctagtctgcctggcttacatagaaagaccctgttgtagcacaaaaataaaagacccatagacaaatcttcaagcttcaagctgaagatcagagaagcaaggcagccaagccagtagatcttacctctacccagctgaaatggcaatcctgtctccacaaagcctcagactcaaaaggctctcagatcctgtctcctcctgccttttattcctttctcccccagccacataactccttattccacctgcctattgctggcattaaaggcatgtgatgccagatgctgagatcacctttgggtgagctatttcttttaggactgcatcaatttcctgtattctttggccttaaactaacagagatcagtctacctcttaatcctgagtcctgggattaaaggtgtgtaccaccaccttctagctctatggctgctgggattaaaggtgtgtatcaccactgcctgacatctatagcttgtggctaacttttgctttctgaatcctcagtcaagctttaataaatcataaataatatatcaccaaccttgcctaaaaaaaaaaaaaaaggccacgttgtcttctgctttaaactttggcacaaagactggaaggaaacaaagcataaaaatgttagtgggttttgttattgtttttgaaagagggtctcatgtaacccaggctagcctcgaagttgctatgtagctgctctcatgagcctcatacatttaccccccagtgctgggattacagacagggaccacaacactgctttaaattgataatacttagcaagcgtttgttgagctgcttctatattaggtctcaaggatcctcctgctttaaggactttgtcagttttttttttttttttttttttttttttttttttttagaaaaaaaaaaaaaaacaaagctacttgccagcaatcacacttcaatattaaaatttaagatgtttatgtcatgtttcctggtttctttttttttttttaagattttatttatttatttattatgtatacaacattctgcttccatgtatatctgcataccagaagagggcaccagatctcataacagatggttgtgagccaccatgtggttgctgggaattgaactcaggacctctggagagcagtcagtgctcttaacctctgagccatctctccagcccctcctggtttctttaaaataactagatatattttaagtgccattctgctaagtaccaacctaggctatatttaaaaaaagaaagatagtgaggtgtgggtctgggagtgtagatggaggaccacctagcattgtgaggtgtgggtctgggagtgtaaatgggaggaccaccaagcattgtgaggtgtgggtctgggagtgtaggtggagcactactgagcattcacaaagcctttggttctgcccacaacatggcaggtcatcctacccctcaggagggtcagaaattcatcgtcatttccagttatatagcaagtttgagcctcctaggtctacatgagacccttctcaagagaggaaaggaagagagataagcaagaagaaaatgcagtgtttgccaggaagaaacttggaattcccacatctagaaacattcctctaatatttagatatttttctgttccagaaaagagcagcattttcataccctaccacttatagtaagaactcctgcaatattgagcttagccacagaaagactaacagtggctttttttcttttttttttttttttttttttttttttgtgtgtgtgtgtgtgtgtgtgtgtgtgtgagtgttattgttttgtgtgtgtttgtgtatggtgaatgtgcacatgtgtgtgtctatactcaaaggacattgggcattgtatcactctgcaccttatgcccctgacatagaatctgtcactgaacttaagagctaggctggttgctagcctcagctatcctcttgcctgtgctcctcacaacactggtgtttgaggcatggtcatgccaggctttttatgtgggtgcttgtgtttgaactcagtttcccattcatgcttgtgcacagcaagtgttttatcctctaaaccttcttcagccctacaataaagttgttttctgaggaaatagatatttttattgggtttcacattttatgagagaaatttttttttttttcctgagacagggtttctctgtgaaataaccctggccatgctggaactcaccctgtagacctgactgacctcgaattcagagatcatcttgtgtctgctgtctgctgggactaaaggtgtacaccaccattgcccgacaaaacttttttttattacgtgtatttatttgtgcgcgcgcgagagagagagagagagagagagagagagagagagagatgtgtgtgtgtgtgtgtgtgtgtgtgtgtgtgtgtgtgtgtgtgtgtgtgttcgttcgagcatgcgcacagtgcatgtgtagaggtcagagtataacatgcaggagtcagttctctccttccaccaggtgagttttggggatcaaacttgaattgtcgggtttggcagcaagcacctttatctacatttgtctacatttaggcagactattttgcttggccataaggtatacatgaagtgtatatacatacatacatgcaggtaaaaggcccataaataaaaatagaaataatactttattaaaataaatcagtgtcaggaatgaagagcagtagtcaagagtgcttcccctagtcaggcagtggtggtgcacactgttaatcccagcacttgggcggcagaggcaggtgagtctctgtgaattcaagcccaacctggctacagagtgagttctagaacagctggggctacacagagaatccctgccttaaaaataaacaaacaagtaaaattgaaagaataagtgaataaaatgaaaaaaactttggaaagcataagttaatttagcagccagacatgtcctcttcagtagtggtatatactctgaactgctaaatttttttttttttttcacttacaaggtttcctacttttcattttgtcaatgatactggtcagttttctaggttatttttagctttatagaatttcttagttttctaggaagatactgatattgtttgtttcatattttattttttaattttgtttttactgttttgagacagtcctagctgtctggaactcactttgtagaccaggttggccttgaactcacagagatccatctgcttctgcttcctaagtgctgggattaaatgcatgtgccactactcctggctctccattaatttttatatctggctttaattttttttttctttttgagactagagtttcatgtagctcaggctagcttctaactggttacatagctaaggataaccttgaacttctgatacttctgcttccacttttggagtcccgggattacagtcatgaatcaccatgcccaagttttatgcagtgctgggtctgaatccagggcttcatatgtgctattcatgtcctctgccaattgagctatacccttagccctcagttcttttttttctgttcctttgctttgttttctttttttcatgaggaatgttgaactataatagtagcttaagaagaatcatataaaataaggcatcatatgaaggaaatagtaatgagtaaaaggaagaaataaaatttaaattacaagattttctacctactcccacctatcttattttttaagatctcaaggacttttgcttcttgagtacttctgtatttcctgattgatttttttgtcatagatctgtgttaaatatgcttttggatattgaggactaggtaataaactacagaatgatggtgatgtttctaagggtcctttgggaatcagatagtagcatcatacaatgcagagttgaaactcttacattatatctcatttctctttaatttaggtgactactaatgattttaagtgatatattttgttcagaatgaaagaactctatcagtagagatacttaatttgaaggcaggttggaagcaaaataaggaaagttgtcaagaatgactccacagtttttaactggaacatctagaagttagaatcaagacctactgatgaaaatactcagagagtagaggtctatagaaaagatcaggagttgagtgtttgtaagcacagaaccatctctttagcctcaagaaaaggaatctttaaagagactgagaagaaattaaccagaagaccataaacctagaaaatgtgtcttgggaactcaagggaagatcgttgtttatactagaggaagaaattgaaattttactgataatagaatgaatactagaattgaaaattgtgtttagcaatgtgagtaccatatattattatgaagcttttagtatgaaaggccagactatagctatttacatattcttttttttttaaagatttatttatttatttatcatgtatgcagtgcgtgccagaggaggacaccagattacattacagatggttgtgagccaccatgtggttgctgggaattgaactcagaacctctggaagaacagtcagtgctcttaacccctgagccatatctctagcccctatttacatattcttaaatggaaaattttgatgctaatagtatttcatttgtcttgttttcaggtttgctgtcttattgatgatatgtctgacagtggatcacagcttcattcagtgggtagcttgaccatgaaatcacaacttcagatcactggtaagttttttttttgaattttatgtgtattagtgttttgccatgggaagtttcaggtctcctaaaactggagttacagacagttgtaagctgccatgtgggtgctgagacttgaacccaggacctctggaagagcagctggtgctcttaactgctgagccatctctccagcccccattagtaagtcttaaaaaggtacaataccttatatctctgactctcctattaaaaataatcttggtgactggagaacagttaagagcagacccttgttcaggttccagtacccatatcatacatggaggctcacaacttcaactccagaggatccagtaacctcttctgacctttgaggatatctacagctatatgtggcattcatttacatacacatagatgcatctaaattttaaaaaaaagtctaaaatttttctttttttaaatctgagaacaaactctttagtggacattataggcagcaaatcagtatttgatgaatacatgaacagaatgttgagatacataaaaataattttgcctcaagacattttatagattcattctccttcattaaactggtatctaggtaattactcttggttattaataattttattgagttataaacagaattgatccattatcaccacaaccaattttatttaccctttaaaattttaattttgagaatttcatacataagtactgcatttccatcatttccatccctctccctctaactcctgtgttcttccctactcaaatgtatgacctcttctttaattatgtttttttacatacacacacacacaccacaaaacacacacacacacacacacacacacacacacacacacaccccacaaaacacaccctactgagaccacttagtgttttgttgttgttggtggtgatggtgtgtgtgtgtttagggctgactacttggagctggataacttaccagggtgctcattcctagagaagactgactttccctctcttaggtcattaattgtctatggctcttcatctacgggtgggtcttggaagatttttccctaaccacattggtgttggctgatattgtcattgtgaagcttttatttaggggacaatattgttgagatttcatgggtacaatttctgtgtcatatatagaagacactgtcttgcagctgaagttcacttgtctggcttttcaaatttttttgctctctcttctgcattgttctctgagtcttaggtataaggttgtgttgtagatgtagcaattggagttgggcaccctatgattaattattctctgaattttgaccagttgtggatttctgtgatggtccctatatgctacaaaaggaagctacttttgtttatttgttttttgtttgtttttttgagacagggtttctttgtgtagctttgtaaaccaggctggccttgaactcagattctgtctgcctctgtctcccaagtgctgggtgagtgctgggattaaaggctttcgccaccaccacctggctgaagctactttgttggagggtgaaaaatacatttatctggatataaggataagtaagtacctagaatgcaatatggatttcaggaaagttatagtagtagtaggttttcctctaggcttcatgacctcaccaaccacaggtagttggctgggtttgtggtagcaggcatgaattctctccaattgagtgggccttaaatggctgttagttacccctaagatgtaagtgttactattgtacccttgtgggtatctggctgtgctggtcattgttatggttcaaaggctttacatcagggtaggactgttgattgcttttctctcctagcagcctgcttatcatctttggatactatgagagctagtccatagggaggagacttccaggtcagttccagcttgattcttccaagtcctgtgtccaaagtgagtgtaaggtcttgttttcaagttctgagagaccagttagagcaatggcaacagcccttactgttttgggagtcccttggactcttctgaccaacagctgaaaaggaggttttctatgtttggtctgggacttttgttagatgtctattgctcttagggggagcattatcaccctaaagggcataatttcatttaagaatatgtttatgtatgtacatacacttatatataaatgtacatatgagctatatgtaaatacttagttatatgtgttatatattaagtcaacataaaatgtttccttatgactttctcaaatctccttagtcttatttatcccttccctacttaaagtgctttgcccttcttttttctctcatttcctgctccatagaacccatgtgctactattctcctctttagagctcttcctacccactccacccccatgatcccttgtactttcttggtttctgcagctacacaaaaaattatatactcatatctaaaaattcagagatggatccacaagtaagagagaacatgtagctgtcacctttctgggtctgggttagctcactcaggatgattgtttaaagttctatccatttatttacttgcaaattgcatgtcttttctttgcagtgaatagaattctattgtataaatgtacaacgttttcattatccattactcagttgagcatttagattatctccattttcttggtattgtgaatggagcagcggtgaaaatggcttagcaagtatctggaaagtagtttgtcaaatcctttgtgcatatgccaaggaataatacagcttggtcctaagatatatctactttttagcttttagagaattctctatgctgattttcatagtggtggcatcagtttgcagtttcacccacaatgaagattcctctttacccacatcttccctagcattcgttatcagttgatttgtttgtttttgttttattttagtcgttgtgattggggttagaaatctcagagtggttttagttttcatttcccaaattgctaatgatgctgaacactcctcccttcctcccttcctctcccttcctctcccttcctcccttcctctccctccctccctccctccctcttgatggagtttctctgtgtagctttggagcctgtcctgccctacgttctgtaaaccaggctggcctcaaactcacagagatctgcctgcctttgcctcccaagatgctgggattaaagacttgagccaccaactcctagcttgatccatttttcaacataggtgcttagagttataaacttccctcttagaactgcttttaatgtgtccccaaggttttgttgtgttttctttttcatttaatatgaagaaatttttatttctttctagatttcttcctaaactgcttctttgactgatccatcattcagtaatctgtttaacctccatgaatttatgcaattactagagaaccatttaatgtttattttaagctttattacattgtagtcagatagtatccacagagtctttcagtttttctgaatttgttagcatttttgttttgtctcctgagtggtatattttaaagaagtatccatgggctcctgagatcatgttctttggtgttaggtagaatattctgtagatatgttaggtccatttgatgtgtcatgttgttttttttttttatttactttgtgttttgttttgttttctttgacaaggtctcctagttcagtctggtaccaaatatggtttgcaaccaaggatgaccttgaacaggggttcttttgcttccctcctaagttctgggattggagacatgctgccaagcctgctttagccattttagaatgatttttgtctctccagaaagaatccttatgtccattagcatcacaaaccatttactcttgtgaatagtaaccacaaatctaggcagccacttaatccactttttgtggatttggatctcttttaatacaatttgtgaccttttgtgtcttctttcgcttagcatgttttcaaggctcattcatgttgtagtatatatcagcacttcacttctttttactgctaaataacattccattatgttaatgtataatattttatgtatttcttacttgatggatgtttggattgtttctgcttttatttatttttacattattttatgtgtgtgtgtgtgtgtgtgtgtgtgtgtgtgtgtgtgtgtgtgtgtgtgtgtgttcatttctatgcccatacaagtaagtgtgcatatgtatagaagccagtggacaatggttctctccttccaccatgaggttctttggatcaaactgaagtcctcggtaagcgcctctgttctctgagccatcttgctagagttctattttttatctattatggataatactctataaataatgttacgaacatttgtacagtttttgtggggttgtgtgctttcttcttacttggatgtattcgtaggagttgaattgtttgttcatatagtatccatgtttagcattttgagaattctaggttgtttttcaaagcagatgcaccattatgtaatttcatcagcaacataataggtttctaatttcttcatctcttcccaatacttgttgtctgtcattttgattgtacctatcgggttagctgtggttttgttttcctgatagctaatgatgttcagcatgtttttgtgtacttgttggctacttttatatctgttttgggaaaatggctattcaaatcttttggttcctgttgttaagtaacatcttactctttgtttatccctttagccatactgtatatcattttaagattaatattttaacatgccaccccttaggttatgtttctgctcagaaacctgcattgcttcttttcattgaggtgtagaagttttttagtctttgctatgatttttctacactgtagctccatgtggtcaagatgagatgctagatttttttaaggcaaagtaggtacctatagatttattatacagtgatccccagtctctttccctttaacatttgttgattatagaacactccacaccctggtgtattacttagtttctgctattcctggtttatatcatcttctagattgtgaatgtgttaggccacaaaccgtatccctttttaaaaattgtgtgtttatgtgtgtggcctccaacacatattttaattgctgcattcagtccatcaaaatctgagggcaaactgggctacagtgtcacatgcctttaatcccagcattctggaggcagagacaggtggatctctgtaatttgaggccagcctgatcaatagagtgagtttcggtacagcccaggctattgatatgaagaaaccctttctgggggtggggtgaggggggagtaacttcttgatgatatcacagttattgtctctagccattttaatcttttgtctaaaagttccaaggatactcaaatacatgacttaaaaaaaatgagcaaagcaaacaaatataataagggattgggaatatggttcaatggtaaaagtgcttgctatgcaaatatgaggactctggagttcttttccccaagagatccaagtaaattctgggtggctgtggtagcctgcctgtaattcaagccttggaaggtggagaagttagcaagagcagccatatcagtccactgtttaattgagagaacttgctttaatgcataaagtagaggagcgatcaaggatgatttccatcatcaaccttgagccgtcaaatgcatttatacacacatgtatagttacccacatacatgcaaagacttatgcttagacacttgcacacaccacacacaagaaaaatggaaaaacaaaaataacagataaaattattttcagcaaatatatcatgtatttttcagctttctaatactgtaacaaatatctgagataatgaatttataaaaagaaatggattgagccagtgatggcttagtggtaaaggcacttggccatgaagcctggtgatctgagtttaatctatagaacccacatggtggaaggggaaaactatttcccttaagttgtgctctggccttcacacttgcaccgtggcacaaacactccttccaacaaataaatataatgtaaaatgtaagtatatatatatgtgaaatataagtaaatgtacatgcatgcatgcatacatgcatacatacatacatacatacacaaacacatgggttttaaatctactgttttagttagggtttgtattgctgtgaagagacaccatgaccatggtaactttttcttttttgagacaaggctgtctgtgtagccctggctggcctggaactccttttgtagaccaggctggcctggaactcagagatatacctgtcttttgcccccccagtgctgggattaataaaccttccccgcttgatcatggcaagtcttataaaggaagacatttaattggggtttgcttacagtttcagaggttagttccattgttaccatagtggggagtagggagcatggtggcacagaggcagacatggtgctggagaagtagctgagagttctgtattcagatctgcaggtagagagagaccctgggcctgaaatggcctttgaaacctcatagcctgcccccagtgtcacatttcctccagtaaggccatacctcctaatccttctaattctttgaaatagtgccacttcctgttgactaagcattcaaatatgtgaacctatgggggccatttttattaaaaacaccataccatgtcccatgccagctttgtgtgtgtgtgtcatacacacacacacacacacacacacacacacacacacacacacacactatattagcggaaaacaaatgatttggccatgctagaaaattatttgatctgtgggaagtcagagatttatggccctcccctgggcctgtgtttgctctgttagagtgcatgttgtgctgcctgggctataaactcattttggccaggcatggtggccatgctcatggtcctggcactggctatgggggtggggtggggtctcttgatagttgtttgagtatctgatgtgtagaagtcctaagtgtatatttactaagataggaaaatacaagaaataaaaatattataaataaataaaattaataatattttagaaaacagctgcttctaaataaaaataaccagctaaatctttaatgaaatggcattaatcaaggaataaactaatatttcagatgttaaagtatcttctcttttcttttacagtcatctcagccaaacttaaagaaaataaaaagaattggtttggaccaagtccttatgtagaagtcatagtcgatgggcagtcaaagaagacagaaaaatgtaacaatacaaacagtcccaaatggaagcaaccccttacagtgtaagttcctatacttatatatacatgatacttgtatgcttgtttatacatgagcagagatgtgactccaatatgcctgtttctttgcatccccttttcttttttacctttcccacctgctcctaggactcgttcctctagtttactttttgtttctctttagatggtttcctgtctcttctggtctgtcttcatcttctccagtttagttggtgtgatggtatcactgtagccattgaagacaagtgggaagaactctttataatagctgtctctcttaattttagttttgtaaaaaagtcatacattaattagtattatatttacatcattataatagcctttaagaaagattttattttatgtgtatgtgtgttttgcctgtgtatgtggctatgcaccaaatgtgtatagtgccctaggaggtcagaaaaaggtgtcagatcccttggaactggagttacaaatggttgttagccaccatgtgtatgctaggaagagaatccagttcttctgcaaaaattagcaaatactcttaatccctgagccatctttctagtcctagtagcccttttcttagattggggctgaatcaggttcagagattaactcactggtttttttgttttgttttttaaaaaaaaccttttgttttgttctgttttgagacagggtcttgcttcatagttcagatttgcctggaacttgctttgtagctcagattagccttcagttctttatccctttaactcaagcctcctgaatgcctgtgcttctgtgtgtgattctatgtgtgcttctgtgtgcgcttctgtgtgtgcttctgtgtgtgcttctgtgtgcgcttctgtgtgagcttctgtgtgcgcttctgtgtgagcttctgtgtgtgcttctgtgcacagcacttgattatttctgttttcctttttgagacagggttcaatgagtgctcaaatgtgtcaggttgtactaccaatatctgacattttgtcagtaagtattgaaaatgagtgctatcttatttttatgaatttattcagcacataaaaattaccagcatacatgcacacgaatagctataaattatacaagcctagtaccttaatattagcagctattagacgacaactactataggacagaaattacatacctacataaaggatattagatgtgtatacactcagctgcaactgtaaccacgatatgattatataaaagcagagttataggagctggaaagatggcaaagaatgtaaaatgcttatagtacaactccagcgatctctgagtttagtccctagagcccacaagaaaaatttggctctacaaagttgtgtcctaacttcatgaataccacagcatgcaccccctcataaacacacacaaaataataacaaattaatttaaataaattaaaataagggacagagggtcaactcttaaaagactaaacatacttcaaaggaacagagtttgattccagctccaggggatctatggctctcttctggcatctgaagttacccacacccacatgcatacagagatgcacatacacataaataaaaaaattaaaataaagtattttttaaattaaatttaaattaaaaataaataaaaacaatgctatagaataaaatatatggtataactttttgtcatatataatatcttaaaaatataacaaaattaaattttggtttgcaggggcactatgattgcacaatacaaaactatttctttttttaagatttatttatgccaggcattggtggcgcacgcctttaattccagcactcgggaggcagaggcaggcgagaatcgggagttcggggccagcctggtctccagagcaagtgccaggataggttcaaaagctacacagagaaaccttgtctccaaaaaccaaaaaaagatttatttattatgtatacagtattctgtctgtatgtatgcctacatgccaaaagaagacaccaatgtcactatatatgattgtgagccactatacatggttgctgggaattgaactcaggacctctggaagagcagccagtgctcttaaccactgagccatctctccagccccacaaaactatttctttaaacagtgttttacaatgtggtccaggtatgcctaatacttgtaaaccccctatcttagtctgagaagtctgggattgtacgcatgtactgccacacccaacttatacatgcatacaaaaccctaatttaaaaaaaatagagttgtggggatggtggcgcatacctttaatcccagctctcaggaggcagaggcaggtggatctctgagtttgaggccagcctggtctacagggtgagttccaggacagccagggctacacagagaaaacctgtctcaaaaaagaaaacatcagtaacaacaacaaaaatgcaaattgtttttattacctgatatttgtaactcttgattttgtttcatttaaataattaaactagcgactagtaaaaaaaaagatttcttttaaatgtcaagatgagaaactataaggttttctcttcaaacaataaattttacttggttatatttattcccagtaaatatcaaaccaattgttatacctataatatgaatgtctgaagtcctaggagcattttgatgtgtctaatgataattttaagaaaataaataaagtttaaaaattacatgcatgtgatcttcttaggaggatttaaaatttcagaccagccaggtctacatagtgagtactaggccagccagggttatgtaagtcggaccctgtcttaaaagacaaaagagataaaaataaaattgaattaataagaatttactgaagaacaatttagattttgtttgcagaattttcttgatcttttaatttatgttgccttggaaacagcattatagagtacattctttatggtgtgcttttgccaagcatgaggtatgtgcttctgtcttgagacagggtctcattgtgttgttcagtcttgcacatctatatgttatggttatcctggtgactttgcctccagaactgtgaagctttgtgtatctgttttagttttcaaaatgaatgatggcctgtggaacttttggtgtattccagtagaatttagttcagatttgagctagcttactagctggatgaccttggcagtttgctcaacttctctgagggcatcatttttagtattaattctcatatgacacacttactgtttggattaatgaagttaccccaagttcagtgaaatgcatctcataagtaagaattcaatttgtaaattcactaacttcaaaaaatgaatttaaaaattgacatgtaaagttatgtatttttctggagcatattttattgtttcactaaattcactcctttaatagtttgttaccttataagcagttttgtttcgtgtgtgtgtgtgtgtgtgtgtgtgtgtgtgtgtgtgtgtgtgtctgtgtctgtgtctgtgtctgatcttacaggccagttgcattcaaatacaggtttcttgaggtttcagggcataggccacctggctaatagtaaactttaagaggcccagtgagggactgcctacatagctcagtaggtaaaggtgcttgcctccaagactgataactggagttaggtccctgagacctactgggtggaaggagagaaccaactcctgcaagttgtcctttgaccccccacatcccactaaataaataaacataatttattttaatttaagaaaaagaggtacaatgaaaagattttagatgttaaagcttgattgtaacttattaaggatctcattgtgatgtttaatgaaaacaatgtttccctgtttttttattttcagtatcgttacccctacaagtaaattacatttccgtgtgtggagtcaccagaccctaaaatctgatgttttgttgggaactgctgcattagatatttatgaaacattaaagtcaaacaatatgaaacgtatgtatgtaagagttacgtaaaatgtactgtgcttgtttttggaagaaatgtatgtcagagtaacataaaatatactttgttggtttttggaagaaattcttatgttaaacatgtggaacagctcacatcattatttgtcttaaaatttaaatgattattgagctgggggtggtcgacacacttaattgtagcatccaggaagcagaggcagatggatctctatatatattgagttccaggccaaccaggtctacattgtgagatcacagtaaaacaaaacaactacaacaaatatccatgtggttttaaggagtgacagaaaagtgttaaaactatttaaagcattccaaataatcttggttttggtcattcattttggagatactattttagtaaatatttatttccttaagtatcaataaagtaatacatagtaaattatagagaaactaaaagatttaaagcagtcatgaaggaaaaaaatagttgagaaagacaaatgtgctgttaaagttataggtagatttctcagcatttgtttctgctgcttaattttgaagtttccttgttttaggtggttgttttattttcatttataaagtcataactcattttagttagatctcatattttaaatgtgaattgttttttgagcccttgacataattctaagaacttgtttctttatttagatctttatgatatataatcgatttttaaattatgttttcattcaatatagcccaagtttatattgataaatgatctttgtttttatgctggtttgatttatactattgttttttcaaggggggatgactataataaacaatatggactatatttcttgttatatatgttctattaagtattatatatattggtgaagtttattttctttttaaaaagtaatgttctggtctcaaaggtccttaaacctttgtccagtaaaacagtttacgaataattgaaagtgtgatgtttcttgtataatttgttctttttcagttgaagaagtagttatgactttgcagcttctaggtgacaaagagccaacagagacaatgggagatttgtcagtttgtcttgatggactgcaagtagaagctgaagttgttactaatggtgaaacttcatgctcggaaagtaagtgattacttttttgttgttgttttttcatgaaaaagtttccctgtgtagccctggctggtctggaacttgctctagagaccaggctggcctcaactcagaaatctgcctgcctctgcctccagagtgcttggattcaaggtgtgcacctccacagcctggctaagtggttacatttcccctcctttttttttttttttttttttttttttttttttttttttnnnnnnnnnnnnnnnnnnnnnngtttttcaagacatggtttctctgtggctttggaggttgttctggaactagctcttgtagacaggctggtctcaaactcacagagatccacctgcctctgactccctagtgctgggattaaaagcttgtgtcaccaatgtccagctccacctccttttttaaagatagtaatatattgtgaagacaaggctggtttgtctctgtctctctctctctctctctctctctctctctctctctctctctctctatctatctctatctctatctctatctctatctctttcgtgtgatgagtggtggtggtagtacacttacctatgcatacatcagtggatcccaaaggttgacatcaagatgtcttcctcagtcatttgtctgcctttaaaaaaaatatttttaatagtatgtaagtgtatgtttgtctgtaagtgtatgtaatgtgtgtgtgtcccctgagcaatctgatggagctaggtggttgtggactacctgttgtggatgctgggactctaactttggtccttgcaagagcaatatgtgttcttaattaccaagccctctctccagcccctgtctgcgctctctctctctctctctctctctctctctctctctctttctttctctctgtgtgtgtgcgtgttttgagacaggatttctcacaatcctactttgtctagggtgtctaaccagagagccccaggatccactgtttccagccttcttcttactgctgggaatataagcatgtgctgccacaccaggtttctgtatggatgctaaaaatctgaacctgggtctccatgcttatacagcaaactctttaccactgagcatctcgatagtactaggttggtcttgagatcccatctcttgccttggccttcccagtgcaggaattataggtagacacaggccagaatgcccagttcagtcactactttgtggttaaggtctcttatgattcttctgacaaacaatagccagtgtggtatttgtaattattgttattactgttcttttctccagagggaaaaaaaaaagtatttattttcttttttaaaaggtattggtctaggaatatagcttagtggtagagtgtttgcctagcatgtatgtgaccctaaattcaattcccagtatcataataaaatacataataaatagataccgatcatattaaatactttgttttgttgcaatgtttctataaattttttaaaaaatttcaagttaaaaagctggatgaataaaagttgaatcacactggacagtggtgttgcatgcttttaatcccatcactcaggaggcagaggcaggcagatcttggagtttgaggacagccttgtctacagagtgaattccaggtcagccagggataccctgtcttgaaaaacaaaataacagcaacaacaaaaacccccaaaatcccaggcaaaatatttttgtgctggagacatggcccagtggttaagaacactggctgctcttccagaggacctaggttcaattctcagcacctatatgatagctcacaactgtctgtaactttaattctggggaatcctacaccctcacagcaacatacatgcaggcaaaacaccagtgtatgtaaaaaatagatataaatcattaacaaaagttgaatcacagttggtctgtgactattgaactgattgataaagtatatcctggatgctattcatgtcagctaatatggtctcctccattgccagtggtgggtttgtgttgccacccgcagcagtggctgcttgagtttaaatgactccagtcctgtagtacttgacagtcaggacaagctggagtccatttgccatttccactcccattctgtgagccacacttcacagggatatcttctgtgttattatagttaaaagcctgattcattttacagtttgtagggtataccggtttgtgttaaagtggagttaaccatagtaaggaactttccagtaacaccttatctggtattgtcttaagtaaaacttctttccagtttttttttttaaataatttttttagatttatttatttattatgtagtattctgcatgcatgtatgcctacaggccagaagagggtgccaggtctcattatagatggtaatgagctaccatgtggttgcccggaattgaactcaggacctttggaagagcagctagtgctctaacctttgagtcatctctccagtctcccccaccaccaccccagtttattcttaacagatatttctctcatttagtaatatactaaattattttaccattttaaaaattttaacccttttcctgcttcttctctgcactctattctttttcttttcctcattcctctttttaaaaaatttatttatttattatgtatacagtcttctgcctgcatgcctgcagagggcaccagatctcattaggtggttgtgagctaccacatggttgcagggaattgaactcaggacatctggaagaagagtcagtgctcttaacctctgagccatctctccagtcctcccttttttttttttttttttttgacaaggtctcactatatagctgtcctggaacttaactgtgtagatcaggctggccttgaactcacagagatccacctgcccctgcctcctaaggactgggaataaaggtgtgcgccaccactctatttttagaaccaaattaatagtttggtatttggtctgagaaagacttgtttacttagaactgaattataaagtagttccggtgtgaccctctgttgcttcgttggtggaggactttctctttagcacaactttttttttacagcaggaacttgaagatagttctgaagaattttctacactgtttttaaattacatttttcatttattttgtgtgtgtgcgcgtgcgagtgctcagtgagtgtgtaggagtgcttgtgccatagcatgcatattgaaatcagaggacaaacgcatgagagtcagttctttacttgtaccatgttggttctgagcattgaattcagctcattaagcttgatggcaagtgcctgaatggactgagccgacctgtgtcctgcctcttttttttttaaagaaattataaagtagaaggaaaattcagaattgattatactgcttccgaatttgaatgttattaacaggatctgtaatagttacattgacatacacacacacacacacacacacacacacacacacacacacacgaacgataaaatatagataaatcatattgctaagcttggaatcaagcccaggttctctgcaagagcaacaggttctcttgaccactgagccacctttctagcccctatagtctttgttttgatttttcaagacagagtctttctacattgccttagctgccctggaactcactaagtagagcagactgtcctctaagtcagagatccccatgcctctgcctcctgagtgctgggattaaaggtgtgtgccaccacacactgctcctttaggattttttttttaagtgacttacgtttcagtatttttatgtgctcaaaatattagctaacttgctttcccccaaaggacaacagaattcctttgtcattgttatttattttattttatataagtgttttgcctgtacatatgtatgtgcacctgtgtgtgtctggtttccacagagatgagaagagggtgttggaactatgactaccatgttggtgctggggaatggaactcaggttctttgtagaaacaatatgtgctctaaactgctgagtcagttttcctgctcctgtgtttatgtttttatttgacatgatgggtggtactttaaaaattgaagcagttaggctgtggtcatattttttaagtaggacttgtaccatattcattaatttttttcaatttacaaagcacttggatttgcattctcctatttagtatgtgtttgaggtctaagcccacattataaaataaacactcatgaaaactaccacacagtctatatattaaagacataaacagtgtcattgaatatatctgtatttttccttctgtatcatttcttatgtttttttgtagtaataatttttctgaattctgagttaaaaaataaacagtatattacttgtggttttttaatcttgttccttttgtttgtttgatgctttttttttgtttgcttgttttttgagaccacatctcagataagccaggcttggcttcaaaatcactattacagctgaggctggattgaattcgttctcctcttacctactctgcctacattctggggttataggtgtttgcctccacacctaagtatttcttgagctatatataatatcaatattattttttgagtttatgtattgttgtttctgagctcatttatttttcctgttttataaaatttgttaggtaaacatgctagagttttatgtcaaattatgtttgggtttttaagtttttgctgttataaataatgatatagtagatgcttcttgaatatctattgataagctttcttagagattatatccttaataaaacttttagggtttaatgttaagtagaatgaactggtatgttcatttacagcttataatatttattgcttcttcaggtatgttactttttattgtttaggtgtttttaaattaggtgaaatttatatatcatgtagttatcattatcaagagagtatgtttggcatctctgtacattgaaaactggaaccctagaacaatactgtgctttctcctttacccagtccctagtaaccttactcatctgtttttggtttctggatttccacattatgagaatatattatacatattatttacttttctcatgagtattgacagaatgtttgtcataaacaatttaaaggaggattttcttattttagctcctggtttcagaagtatatgtctaccacaacagggaagactatgacagaacagagtaactcatattatgggagtcaggaattaaagagaaagaaaaatagggaaaggtcaaggaagcacattatcccaagaatctctgtgctccatgacctacctcgttcaagtaatccccattacctgcttcccgccacctctcatatcctctatatccatcaagggattaatcaattcaccaagtcagatgagctcatcatctttggaaatgccatcatttgttggtactttactagcctcataggcatttcttaatccagttaagctgacaatgaaaagtaactgttgcatcatattaaatcatagctgaatttttgtgagtgtatgtgatgtgtgcacatatccatgttggtgtgttcagctgtgcacatggcagctaggggacaacagtgtttgtcctctatcatcttgtcttgttctttgaggcaaggtcttccgttatacttggagctctggtattttggctaactgaccaccagtcatgtgccaccatgatccatacattgtcttttaatgcatgattttcctctgtatttttagtttaataattctactatctaaaacctgtggggatagaaatgattttaaaagttcttgttgttttcagagtcttgatatatagtactgactgccttggagcttactatgtagactaccaagatggcctcaagtttgcaatagttttcttgaatctgcctcttgagtgctgagtgctaaaattataggcatgcaccaccatgttgacttagaaatggtcatgtctttcccttactggggctcattttgatttttattttatgttctttgattgccagtttccattttatcttagtctaccagaattttaaaggcttaatttgggaattctttactttagagaaaatgtcttttgctttaggtagtgccagggtttgctgcaacctaaaaacgttttatctgctttctgcggttcctagcttaatgttcagcacttcccaccttgctgctgggctgagactctctgatccacctcagatctggcaactgccacaagataaaaatgttttcaaggtgcttctagtttggtatatcagatcaagtttttgttcagtttggagattgtctggccaccaaggaatatgaagtgcgttaaatttctttagaaaccagttgttttgtggtgggagtgctcttgtaatttagctcactgagacgaaatctttgtagcttttccagattttcctgtgggtaaaacatgttcagttagaattttgatatggttttcttgtcaccttacccttctccaagtgaccttatttatgtattatctatttattgtgtgtgtgtgtgtgtgtgtgtgtgtgtgtgtgtgtatgtgtgtgtgtgtgtgtgtgtgataagcatatgctgcagtgcatgtgtagaggtaagtagtatagaagacaatttttggagttggtttcatctgctgcctagatgagacaggacttcttttggctgctatgctgcacactccaggcagctggcctgagaaattctaggcatttctgtctgcctcccattgtgctctaggagtgttggattatagatgcacaccactgtgtcttgatttttcatgcaggctccagaattgaacccaggttgggaggtttggcaaatgcttttacctgctgagctaccctctaccccccattcccagtgacttttttatttgtggaagaaatggaatactgatttgattgactattgaatgccatatatacattttttggtatagttttctcattccacttatgtcctacatatcaatcaatcataagaaagtatacataaaaaacattgtttaattttattttggtacagtttcatactggagctcagactgacctgtaatcttactgtgtgtcccagactgaccttggattcatggcagtctcttggtgagataactgatgtgaatttttgcacctggtgtgtacagtgctggaactcagagtcagggttttatgcatctttaaacaagcattttaccaaggtagttttaagcattctaccaagtgagttttgtcctaaactctgttttggtttggcttttttttttttctttaagattataaaactcgtctttaatcaagcttgtaacatgtaacagaattgtcagataaactggaaagtttccaatatattgaaacaaacccataagtcaccataaatacaatacccaaaataggaaaaccacaacaacaaattcatacttgctctgtaacagccatgaacaatccagacactttctcagtgtagcagatgtggcctgatggatatggaccacactatggctttggggtcacacatatctgatagcactgtggcattgttggcttgactcatgaagcaatgcaggtcccagcacattcaaacagtggattgaatatgctttaaatattgaagtgaaaaggaaagcaacataatcatgctgtcagaaagatattagagagtaaggacagctgtgtaaagcttgaggctgagaggtggctcacagcttcatttctttgacttcttggataatggctgcgagaacagtaagatgtgaggttctggttcatgggtcacccattcctgactgctgaatgccaaaatctctccagtcagattcagacatcacatgggttctaggaaccagcatggctatgtctttgggcaaactgacatgctggtatttgaactctatctatccacatgctaaatttgtttgtactgtgtgattgctctgtggaggtcactcaaccccctaccatcaacttccagagaacactatgtcatgtttgtagagatcactttaatactttattagactacattttatatgtcgtaagggtcaccatttcaaatgtgtaggtaatgactttttatagaaatcattatatttattacatgtgcttgtatgtatgtatgtagatgtatatagtgagagtatggaggttagagaccagcttttgtgagttggttctctcctttgatcagatgggttccaggaatcaaactcaggtcatcaggtttggcagcaatcacctttgcctgtcatcttgcccacccacatttaacatatttttgagataacatgtgttaatttgtttttaatactgtagattttaatgcagtttcaattacaaagcactccacaatttatctattccactatcatttttaaatgtgtatttctatcatccccagtacttataaaagaaaaacagtagacttctacaacccttgatagatgtggcatttggttatgtgctgtggtattgcgtactgtgattttattattgaaaccgtggctgcgtcttggggatttttttgccagttgcgcttagactgctcaacttgagttgttaaacagttttcagttttccttctctttctgtgaataaaattggaagaatacatgaatattaaggcatttatttgggcctctttgaaacttgattagtttttttttttttttttttttttttttttttgcgcggggttttctttttcagacggagtcttcctttcagagagttctttgtgtctttcattttctcggaggttttttttttccagctcttttatataaagagttattattggctttgctatttcagagttgttttatattgactgttctgttattgattagtacttttctcccatatttcagataaagtaagtagtaaaaaggtgtgtatgagggtgtacaacgagactgaggcaggaacatgagttcagtgccagcctgagctttgggaaaatggctaattactgggtttgaattggagcaaaaaacatttcaaaacaaaaaatgcagaagtagggtatgagtaatgcaccttaactaatctctcattgaataacgatatatatagaattgaatttgaacattgttctattttccctttaaaatttatgtttggatattccatactagaaaggtttaatagtttagtataaggcttttttttttgtttcagttgaaaattactctcttgaatctcattttgtttaaatttattgttcaaggtacttcacagaatgatgatggctgcagacccaaagatgaaacaaggtaggagttcactgattgcttatcacagaatgcagaaagaattaacttgtgttaattcatttaacttcaggtttagggggttggaaagttggctcaggagatctaatgtcttctggctttcagacactcatctgtacatatctatacatacacacaggcacacatacacatgaataaataagtaccaattttcaggttcagactgataaattgtgggccaagtatgctgactttcctgtgtgatcccagcatttgggtggttaaggcaggaggctatctgtgagtttaaagccagcttgggctgcatgtagatttgggctagcctgggctacaaagtgaggaaaccctgtctttaaaaaatcataaaaagttgagggtgttggtgcacacctataatctagcattttggagaaggtaagattaggaatgcaaaacctgctcgagttatgtgaaatgtagtctcaacaaaaaccatgaaaagggtgctagagagatggctcagcgacataaagagtacatgctgcttttccaaaagatccacattctgccagggctcatgtctggtggctcatacactccagttccagtgatccaacacctctttggcctccgtgggtgcctgcataaatgtatgtgcctacacatagacacaaatatacatacaaataataaatcttttaaaatttaaatgggagaatcaaaagcaatgtcacagatcataagagatatttacccagaagtgcatgccatactattgcattgctacagggagaatagatgacttagacccaagcacaggggaacatacctgggatcccagcattggggaggtagagtcaggagggtcaaggacaaagaccaactttgactgcttgagtttaagactagcctgtgctagtaaagggaaatagagcttaatattatggtttggaagttgggcagactagtacaagcttccatgttacctatctacttctgtaatgcgtagaaattttcgtagtaaaaatattttaaagaacagtgttggaacacttgcccagtgtgcccaaagccatggattccacccccaaaagggcaaaaacaaatgacacatagtttattaaaatcgtcaggaaaaccaaagtcataatgttctgtcaaagcaaatagaactctacattctttgaatcacagtatattaatctacaagtatactcttaggtaacttcttactgagaacaattacttataatggaaaagtagttttaatttcacatactttctctgtccttaaactttgtttgtagtcaagactgggctcaaatcccctaatcctcctgtttccatttcctgagtgctgtgtttacaaacatgtgtaaccctgcctggctagaaaaggtttgctaacatagatggaagcctaacattaagggaaggagtcacttaggaaaaggccagtacacacccaatcatgtatgattttggtgccttcagaacttgtttaaaggttcactatgggaactttttaataaatgacatcataaggtggtttctaaaaaacattggactttaattaaaggtgataagagaaaactgtaggaggctggagagaggactcagcagttacaagtactgactgcttttctagattacccaggttcaattcccagaatccatatggtggttcacaactgtctgtaactccagtacctgggatccagcacccccttctggctgctgcaggcaccaaacaccatgtggtgcacatacgtatgtgcagggaaaacatgtatacaataaaatactaaaaaaaattttaaaaagataaaaccataaatcaaaagggtaaaaaagagtcatataaagttatacatttgtttggctgtaaacatcttgtttacatgtcttttcttacacttgtgaaaccactgtagccatttgtttactaagttctttctgtcttcctaggtcaataatcatgatcatagtttctggggacagtgccttctgggtttttgggcttgcttacagagatcaagtggggtgtgtgcgcgtgtatatgtatgcgtgcgtgcgtgcgtgcatgcgtgcgtgcgtgcgtgcgtgtgtattggggctgattctcttgttctaccatgtgaattccaaggatgcaactccggctctcaggctttcccccacgcatctttacctgctgaaccgacctcctaaccctcaaaaatgtatgtagtacatcagattcttccccagggtttgataaagtacagattgctaggtctcattctcattctttcactacttgggtgggaaaaagttttcatatttaacaagttttcaggtaatgttaatgctcttaggctagattgggcttacataacctttgagattacagctgtaccagaagttttgcagtttcataatgtagtcaatttcatagaaaccctagtttactggaaataatgtcactcattttaatcttaccctcttttttttttttaagatagttgaatcttacttgtcttttgaaatttgtttgtgtttattagaaaaagcatacaatcttaaaatgtttaaatgtagtagtattaacattaaaatgtatagtcatggaaaaataacgtttgatgtaagtcttgattgtgatatagatatgcacatcttagaggaattgtggagaaggaggaatttgaaattgaaggaagaaaaaaatagcatggaggtagagagaaactggttttttaatagtgaatgtttgatcacagtgtttgactggagataggatatgaggtggtttgaatagatatggtgcccttagactcatgtgtttgaatgcttgccctattgtgagtggcaatattaggaggtgtggccttgttagagtaagtttgtcactgtgggggtggactttaaggtctcatatgctcaaactatgtccagtgtgggatatacggttcacttcctattgcctgcagctcctccagcaccatgtctgcctgcatgctgctatgttctgccatgatactaatgaacaaaacctctgaaactgtaagccagccccaattaaatgttttcctttataagagttgccatggtcatggtgtcttgtctattcatagcaattgcaaccctaagatgtttaaaagaaaaatgcagttggtcagattcagagtagaattggagttaacattgtttcttatgtgccatctactatgctgaaagtgatgaaaaatacagaaggaggaaggaacttgcctgagtttgtagtgtatgtggtatagatgaatataggaactgcttaatcttcaagagcctgaactcataactgtcatgctttactaccacctaaagctggtgtaatattacataagccaatgtttagtcattattacatgtgaacccttttattgttttttgtttattaagatatgatctaactatgtagctgagactggcctgcaactcagaagctccctacctctttctcttgagtgctagaattaaagatatgcactaccacatctaattgttacttatttcaatttttattttatgtatgtattattactcaatcctttctctaccttagttgttagaaaacaggatttttcactaaactggagcacactgatttggccagactggctggccagcaagccccaggcaccttcccatctctgccttcctagcattctctgtaggtgtcaatactgtgcctggcatattacgtttttttgtggattctggggacctaaactcagttcctcatgtttatgcagaaagtcttttactaacagagccatcttccccatcctgaatattatttaagtattaggtagattgttatatggctaaatagaggtttaaagatacccccttggaggatgtctcaaaaaatattggactgggattgatataatcagaattctataagaaaattaattttatttggcaatggtatgtagtgtagtttgtgttatgggtatgtcagcaatagcagggagatacccccatatgccactagctacttgaagagttctcttctctcttagggatttccatacagttaaggccccaccctgagtataaagggtttcaggatgagccagggtgaagtggagttagttggtgactgcttagacgtataggaaaaggaacagaatgtaactccaaggtgtgactatgggcttcttgagatagagttgtgcttacatgtccttacagtagctttgtatatgatcctctggctttccaagtctcattactcaaagtatataacttattagcaaggtttaaaattaagtaaagcttaaaatttaaataaagtttaaaaattaggacaactagatgacttgacaggtgagaaacatttggtgtttttttactctgaagacttggatttgattcctagaacctggataaaataggaagaagagaactcattccattaggtgtcctctgacctccacacatccagacgtgttcctccccacatgccctaggactcggacctacccccgccacacccaatggcttggatgcacctctccccacatgttgtacacacacaataataataaaatttaaaatcttttaattaaataaaaacacatgagctggttcacacatttctctcatcttaaggactcttaaaatgaacctgtaaggttgtttatgagttatgtactgtagattcagggacaagaggggaacattgtggtaaagctcatagttataaacgttctagtcctcgtaagcatagtgcatttgttgtttctaatatccttttaagatatctttaggaaaacacacattatctctcaaagcaatgtgggctctttgggttgtgtttaagtttcttgactaatcaacaggcaaggtaaagtagatctcaggatgagaggcccctttgccttcttgtgtcctctttaaagtttcctttttatattgcctccagtgaagatgggggaaaggaatcaatatagtagactaagaggtagatgaggtgggtgtggtggaagagtagaggagaatatgaaagcagtatcaagtggacttagaaattaacaacacctagaaggaagaatgacagagttagagagctgtatctcttgcattttgtgagagagtcccactaattacagaaattctgatttggagataatcttcagaattatgggatttgagatcctagagaaaaatctgaagaagaggaagaatcagagggtgattagaaatctaagtacaagatgataaaattagagtgacaagttagagaaaaatgtcttctaaatatggcatgatggggctggagagatggcttagactaagagtacttgcaaaagactcaggttaaatttccaacacctacatggtggctcatagccatccataacctcagctctcagggtccaacaggcacacattcatacacatagatggatgtaggtaaaacattaatacacataaagtaagataaatccaatctagaaatctacaaaaaaaaaatctaatctaaaaacaataagatgagctagctgggcatggtggctcatgcctttaatcccagtacttgagggacagaggcaaggggatctctgtgagtttgaggctagcctgatctacatagtaagttccaggcagccaaggctacaaagtgaggccctatctacctccccacccccaacaaagagatgggatagtactggtttgatggcataatatatttgtagttcctgtacttgggaggttgaggcaggaaatctttagtttgaggccagcctgggctagttatgagacaaagaccctccctgtttcattaaaacaaagcaaaacagtaacaataacagcaacaaaaagcccaaagtatttaatgacattgttaaatgctacagaagtcattatgatcataggttagttaatattctaggaaagctggccatctggcaaaagaaaaatctagcctttgtcccaagacaagagtaaatttcaagttgattttaaatagatttcaaaaaatgaagctataaaaccattggaagaaaatgtggctagttcattgtctagttcaagtcccagcaaccacatattctaattacatagaaatatgaaacttgctactgggcgttggtggcacacgcctataatcccagcactcgggaggcagagacaggtgaatctctgtgagttccagaccagcctggtctacaagagctagtaggatagcctccaaagccatggagaaaccctgtctcgaaaaacaaaaaaacaaaaacaaaaacaaaacaaaacaaaaaaacaaaaaaaagaaatatgaaaattgcatatttaaaaatattatcatggagctaggctgtggtggtgcatgcatttaatcccagtattcagaagtcagagagaggcaggtggatatctatgagtttgaggtcatcctagtctacagagcaaattccagggcagctcaggcattacacagagaaaccctgccccgaaaaaccaaaataaataaataatttatgttaattatatataaatataaatattgtagatatataatataaatattatatatgtatgtatatagcattgaaagcaaaaaggagaagccctttcacaccagtgtgctagataagtagccttggattgtttggcactcttatagatggtggctttcctagtaaaaaaatgtggaggggtactcatatgcttataggcaaaaggattttgaagaacttgatttcattcctgcttatacaaggcattctgaagcctttctaaagccatacctagtaattttgaatgagctcaagttcgacccttgagtgacttctcactgtctgtgtcaggttgttactcttctactgctgtgaagaaacactgtgaccaaggcaactcttagaaaagaaagaatttaattgggggcttgcttacagtttcaaggagttagtcctttatcttaatggtagggaacaggcaggcatgacactggagcaggagctgagagctttacatcctgatccataggcagccagaccgagagagactgggcctggcatgggtttttgcaacttcaaagctcaccttcagtgccacacctactccagtaagaccataccttctaatccttctaatctttctcaaatggttccactttctggtgacaaagcaatcaagcatatgatcctatggggcaattctcattcaaaccatcccaaggaattatataagattaacctgtggcctctttatttgataaggctgacctgaaattagaaaggaaaaaagacaggctggagagatggctcagaggttaagagcaccggctgctcttccagaggtcctgagttcaagtcccagcaaccacatggtggctcacaaccatctgttatgagatctggtaccctcttctggtgtgcagatatacacggaagcggaatgttgtatacataacaaataaataaataatctttaaaaaaaaagaaactttaaaagactatttctcaaattcctaaaataccaaattttgggtttcttggtgttcttaaatgaataaggaacatttattttgttcccttcctctctcccctccttgcccttcttatctagagtgagcacaaatggatcagatgacccagaggttgcagtattgggggaaaacaagagggcaaatgggaacaactctccatccctttcaaatggtggttttaagccttctagacctccaagaccttcgagaccacctccacccaccccacgaagaccaggtatatattccagctttcagtgctgttttaaaataatgttcctttggtaggaagggctgacaacacagtctccagaagttgcccatgttagcctcaaatgcttccttagcccagctggggtcatgagtgtgtactaccatgcttagtgttcttaaataatgttctgtttgggaactgatcgacagctgagtgtcaggtcattggtgttttgtttaagtagaatctgttaacataggctggcctcaaacctagaaatccttctgcttcagccctcttaagtgctgggattgcagatgtgacccaccataactggcttatagctttgtttttacatttaaaaacttgaccaagaatgatctttgcataggtgactaagaactgttttttctttaagttttccttccaggaatgaagttccatgtgagagtgctttattattaagaatgaaaatcatgtgtattatataaagtatgaacagtacagttcagttagattgaaacatctttatgtggttggcaactgtgacatatcttatagttaaaaatttggtttcttagtccattttatcttttaaaaagctgagtgggggcctaaagaaaaggactcaacagttaagagcaacaactgccttaaattcccatcacccacatggggtttactaccatccataactcctgtttcctcttctgacctttgcaggcaccaggcacacatgtggtgcacagacatacatgcaggccaaagacaaaatataagtgaatagatttgacaaaaaaattgttttaaggatttatttattatgtatactgattctgcctgcatgtatgtctgcaccccagaagagggcaccagatctcattatagatggttgtgagtcaccatgtggttgctgggaattgaagtcaggacctctggaagaggagccagtgctcttaacctctgagccatctctccagcccccatgctaaaaattttttgaagcttactggtaaatgatgatcagtttttaaacaacaaaaaaaatcattaaatgaacatatttcatgtagtaacaatataaacattatatagtagcatttatatagaatatctattttctgatcagtagcattaatcacttatcaacaacatcaaaaattagccttagaccttcagggtcacatatagaaggcagttttaaggacctggaaagtggtacccatggtttcctattctgaaggtttttactgggctacaagttgtaggtcagtcagagtacttgcctattgtgcatgaggtccttgtaccataaaaatcaaactaagtagttagtttatatttttatgaattgagaattatatatgctatgtaatttgatgagacctgtgtatctacatcataggttttacttgttatgtacttttaaattcttaaattaaaatttgatcatgattttagatttcagaaagcaaaagattctaatattttccctaaatctttcatagcatctgtcaacggttcaccatccaccaattctgaaagtgatggatctagtacaggctctttgccaccaacaaatacaaatgtaaacacaagcacaactacatctgaaggagcaacatctgggttaataattcctcttactatatctggaggctcaggccctaggccactgaatactgtaagtcaagctcccctgccacctgggtaagtaactgctaacatttgctttcagcttttacatgtattcattaattttaaaaagatcatgctacattctttcattaattgtcttttaagtaattgatttgggtgggggagtatggaatccaagaaagtttatcattttttaaatactacctcttcattttttgggaagcagaaaaaaaattgagctgggtatgttagcacatgcctataatctcatcatttggaagtctgaggcaggagtattattatgagttccagatcagcttaggctacaacatgagactatgtctcaaaaacaggttttttgttttgtttgtttttggttttttttttttttatttttttttttatgtgtgtgtgtgtttcaaggcagagtgttatatagccctcattgacctcaaactcactatgtagatgaggatagccttgaactactgatccttctgctatctatttctcaagtgtgaattacaggtgtgtaccattacacctggaaaacaaaataactcttgaaggactcctactatcacccatagaaagttaatgaaagtcaagtaataacatagtcatgtgactaagtggtgcttctctaggtagggaaaaagcaaataccttttaaaaatatttttattataaaatcatcatagcaagtaatagtttaaactgataaattagtttcataatcccattttaatttgtacttaaaattttttaagaattgtgtgtgtgtgtgtgtgtgtgtgtgtgtgtgtgtgtgtgtgtgtgtgtgtctactcaccttctctgtatgtgtaccacacgtggacagtgcttatagcatagaagaggacattggaagccctggaacttgagttataggcagttcagatccatctgatgtgggttctggatattgagccactgttctctgtaagaggagcaagtgttcttaactactgagccatctccccaacccctatttttaacattaatactttgatcaaattaaaagctcagtcagggctaaagatttagcttagtggtagaacatgtctagcgtgcgtgaagttccaagttttaccttcagtgccacacacataaatcaaaacaaaaattcatgttcagggctcagaatgccagccaaagttatttggctgactggtaaattaataaactcatagtgaacattttaactacggtcacagattatacttattggtaacttaggccattttcttttggaaagctatatggtcttttagttactgtactaaatagtgtgacagaacctgacagagccacttgagggagagattttgacttggtctcttttgttgggaactgatcttaatcactgtggcagttcgaaagcagggcttaagtagaagccagccgggttacagccctcaacaagaccttaccccagcaaccctctccctctaggtagaatctgtatcctaaaggttccacaaccttccaaaagaatactactagctggggaccaagtattcaaagacatgagcaggtatagtaggtggggtggcaagataggaacggtttatatccaaactgtactacatggcaagctaaattagaagatggtttgtactaaagaacacatgatctggggctgagagatagcccttgctactcttgcagagggtcggactcagccacctacagtggctggaaaccacccataactccagttccaggggattctgtgccctcttctgacctctgtgggtaccaggcatgcacatggtgcacgtatacatgcaggcaagatactgacacacattcaataaaataaatgttaaaaaaaaagtttttaaggtatggaacaatggcttatcagttaagaacactggctgctcttcagatgacctggttttgattctcagcaccttcacagctgcttaatgttgtctctacctcctctcttaggggatccgatgccctcttctggcttcgtggttactaggtacacatatggtatacaggtatacatgcagccaaagtacccatacacataaaaataaaaaatcaagtaatggttaaaataacaagctgtgagggtttactgctattctcttctctttggcaacaaacctgctcagaaaactagagtacttacagtggccagtctataaccctcatcctgtaatatctgataatgacatgctttgatttcagtttttctagaatgtaatcagaatgttgcttttcatttagctcagtttttgaggtttcagggcattgacactttctttttctctcaaattctcaagttctgagtatagtttgatcagattgagaaatttggtcttctgggtggatggtctggctttaaaatgcatgttatttccagagcaaacacttaggaaaaagaaacctcattcactgttgtgtgtgtcactcttggggcttcctcctctctttttaggtgataattcttgtctgcattttaattctttttttttttctttatagactaacaggctgattttctttagttacataagatggtcatttacagtgaaaagatgtagacaggattaaaaagccaaactaatacaaaatgtccttactagtctttgatttgtatttaaggtgggagcagagagtagaccagcatgggcgtgtttactatgtagaccatgttgaaaagcgaacaacatgggatagaccagaacctctacctcctgggtaagtgtatgaatttaaaaacaagtttatccagaagaacaaattgtatccatacccagtgttccctgtagtcctgctctccccctcctttctattttgttttatgttagacacagactagaaagaagagagctagagagctgactcccagcatgctgagggtgttgctgttgtgactgattttgtttttggagaccggagtgtcactgcgtatcccaggaggaactcagcttttcagccttgcaagttctggggttacatgcctatgttccatactgtgacgaatgattttttgcttttaacatttctaatttgaagaaccaacccacagttcttattgtttgtattttcatatctgagttgttttcccagctgagagccactgaattttaaattagtttctttttgtttgtttgtttgttttttcgagacagggtttctctgtgtagctttggagcctatcctggcactagctctggagaccaggctggactcggactcacagagatacgcctgcctctgcctcccgaatgcttcgattaaaggcgtgcgccaccaacacccagctttaaattagtttctttaagaataatcatttaactaaataagagttataataaccaaacatggtggcatttgcctgcagtcttagcatttgggtggtagaggctggagaatcaggatgtcatgttagaggccaacctgtgtttaaacctgtctcaaccctccatcccaggtaaagagttgcagtgcctgctatatattaagataaaaatccttgttattaaaactaatatatattaaaatcattgcaaatggttgagaaagttaagaacatgttggtaaccatggtattaagcatttaatgtgtatatcatataaaatgaaagaaaatacttttttaacccaaagggaatatatagcaaacacagggagtgtagtctcctctgaggttgaagattgctcaaaggttaaggtgttcgctgctcttctaggggttgtgagtttgattctcagcacccacaccagccagtttacaaactgcctataactctagctccatgggattcatttccctcttcttactctgtgatgaccagcacacatttgtacatacacacacatacatataaatacaaatctttagaaaaatattgccaggcagtggtggtacacacctttaatcctagcacttgggaggcagagtgtcccgacctgcaggacatcaacctggggcaagagagtcagggatagggaatggggtcaagagacacagaaagaacgaccacaagacaggattctgatcaagtggcaaactttacttttctgaagctagcttatgtagtcaggatatggggaggggcagaatgggttgtttgtcccccaggtgttagtgtaggcaggatattaggaagccacacagaggatgtttggctgggtaaagagtttattagtaagaggtccagggagggttgcctaggtgacggagcctgtgggtggaggactgggtcaagctgtttcttttcttgagctgaggttctaagagctgctatatgtaaaggttaactatgtgccctgccaagcatggcctaggatcttttgccaagcctggagatttggctcccaacagcagagggagaaagatctcttgagttagtatccagactggtctacaaagcgagttctaggacagcaaggctacacagagaaactctgtctcaaaaatccaaaagaaaagaaaaatattagtcttgctagctattaactagcattaactaacccttaaagaaatatatacctaaaaaatgtggtttgacttgttaaattagcaggtcatattaagtgtggatgaggaactctaaccatagtaatgctggcaatagtgtaatttgaacctactataaaaatctttgcagatagatatagatcaatatatataagtatgtggtatatatatttttcttggtaatcttacattatgaaataacttgaagaaaaaactttgttgtcttgaaattatcattttactacaagtaagtaaaaaggtagtacagattgctttttcctctgtgaaaatttctgtatataactgatgtctcccatgatgtttgcaggagtgtaaaggtcagtgggggagaaaaaagaaaactttttcctttgagactctgaatatgtattacatttaaaagacttcattgatatgtgtcacagatttttaaaagacaaaattgtaaaagcttcaaagttcagtttataaatatgaatgaatgagttcagataaatcagaaagagctaaggatgtggctcagtgatagagcactgataagcgtgtgcaaggccctggatttggtcctaagtacacagagaaaaatacttagtagtttctccaggtaaaatttgtcttacatgtttttccgcagatatttcttaaattagttgcttcttttctggtttagttgggaacggcgtgtggacaatatgggacgtatttattacgttgaccatttcacaagaacaacaacatggcagaggccaacactggaatctgtcaggaactatgagcagtggcagctacagcgtagtcagcttcagggagcaatgcagcagtttaaccagagattcatctacggggtaagcagcctattgatttattggttattgtaactaacaaagatcttcagtctttaagaactgcctgcatgtgtcatgaaaagcaccacaaaggttacagagtagggtggcaagtcagttgctgctgtaggtaggtattggtcttgtgagttgtgtcttttctgtaggtgttaaaaataaacaaaaaccaagttagagcaatttaaaattcatggacaagtttggaaagaattaaaacaattctaaagtagaactgcctataactcactagaaaatttggatttctagtggttaacccaacttaagtggttgcatagaaatgacagtggagttgaatcactgaacacttactgatgaaactactgaccgaattctttggtgtgttactctactgaagagttttcattccttatagtaatatactatacatgtttatatcatgtatgtttatgaagtatcttctttacaaagctggatgtgatggtgttcatctattacctcagcatttgggaagttgaggcagatgactcacttgagctcaagagttcaaggccagtccagacagtgcaagacacagctcaaaaacaaaacataaaaataaaagaaataaagtaaactgcccagacatggtggtaaatggctttaatttcagcactcaggaaacttgggaggcagaagcattcggatctccgaattctaggccatcctggactatattgtgagttccaggtcagccaggacccatggggcagggtagggtggggatagacaaacaaagaaaaacaaaatacataatttccttcagactgatacaatgataaatgtattagtgctttccttgctgtgtgatctgggaattttgtaagtcataatgtatcacagatctgtctgagaaaagtaaaatggtccatgccaaaataagttggtttgttggagtagtatttagaactaaaccaaagaaaaccagtactgccagaggcctgaaaaacctggcactctccattgcaattgcctcagtgtcatgtgatcttccctttagaatgcaccagggtaaaacgtctttacttttattccttagacattacctttcctccattttcctgctttttcttttaagtttttatttttattttgtgtgtgccagtgcctggatgtatgtctgtgcaccacatgcatgcactcagcagagggtgtcagattccaatgggttggactgaaatcacagctgcaagagtgatcagtgttcttaatcattagccatcactccagactctcttgcagttttctccgatctcattgttagaatagttaccaattactgatgtgacaagttcgtctttatatcagcagccttctcttcactgctttgttatcatcaagacccctttcactctagtaagtgttttccccaccactgcttctggaaacgtcactatattccccttcctagtgttacatagtgctagggattaaattagtttttggtgtgtgtgtgtgtgtgtgtgtgtgtgtgtgagagagagagagggggggggagggagagggagagcactttcatgggggtgattactgagagaggatatgtagacttagaccttgcatttcttgtggctgccaacactctactcagcttcttgcactcccccgggcatggatgtacaccccttttgtgtccttaggaacctctgtggcagtgacatggtgcactgctcataaagcacaaaggcacatactctccaaatcatgcaccacacaaatgtggtgtgcttggtgaggtgtccccagcactggccttgcctcagccttctccccctctttatcaccttctgtcagttagggcccagtgtgtatgggggggcagtgcagagccattgttgctgtcttcaaggctgtcctggctgccctagtctttttacattttattttgagacatagtttcactaaattcccaggctggccttcaacttgagatcttcttggctaagccttctaaacaactaggattataagcttgtgccagtcatatcctgtccattttctttttaggtctgttctgtggttttacattttagtttctgtgtaaattattataggcaaatttcttctaggtatggatccttaacttgcccactttttccaaccctagttctacatgaatctccaatggctttggagtcaggtacatctagttcctatccactgttactttgagtaattttggatgagctgcttaacctcaccaggaatcatttaccttttaagtgaaatagacatgcccttcattaccttgatggtgttttgttgttatctctgtactcccaactctcttctatagtttatatactatcttaattttatataacttttaagtgttatataatattacatagggttttcaaagatttttttttttttttttttttttttttaaaaaaaaaaaaattttttttttttttttttttttttttttaccaaaaatagaacttttctaagtgtgagtctgtaagaaaatgttgtattgtatatagcagagaatccatattggaattcatacatttgctctgaaatgatgtatttgttgtgaattatttgtctaattattcattttttttattctttttagaatcaagatttgtttgctacatcacaaaataaagaatttgatccccttggtcctctgccccctggatggggtaagcacatcagttttaatttaaagtctgttatttagaagattggcctagagaggcagcttagaatgttggtgaaacgtgggcagagctctaggttgagtcactggcactgcaaagtgaaaagaaacagatcattgatacaacaatctggcaggacctcagagatgctggtgcttagagaagataatctgtttcacaagattgcaatagtcatgttaactttcgcctccagtttctattactatcaccaaatacttgaggcaagatcctttataatgaaaagaggctctgttggggaaatggctcaagtcagaaagttgttggccatgcaaacaggaagatcttaaactgaattcccagaacccaggtaaaaagccaggcatgatagcacatgtctgcaatcccatgggggttgaagagaccaacagatccctgaagctcatttggtcagttaacctagtcagattgatgaccttcaggttcagcaagagacttgtctcaaaacttagggaagccagacatggtggtagatatataatccattttgaaaaatcccattgttttgtccttaaaatcatgtatactatgttggcagagttttccatctggactgcttgctgatcagctctgttccaccagctgctccccaaataagctcacagagacttaattacaaatgtttggctggtagtgcaggctcattttttagctagctcttgtaacttaaattaacccatttctattgatctatatgctgtcctgaggcttgtttacctcatctatgtacttttcatccggccaaagctgtcagaaaatctgactcaactaaataaaggcagagggatagtcagtaaagttgttgctgttcaagtatgagaagctgagtttactgtgtgttgccagacctggataatcttggagatacttgagaggatcccaggagtttgctggctgaccaggctagctgaatcaagtgagttgtaggccattgagagactcttgtctgaaaaaaaccaaggtaactggtacctgagaaggagcacaggtgaggttgtcctctggactcatatgcgtgtgcataatgagcttgtacatgcacatccacacccgctagtggggtggaagaaaggcatatgttcagatgctaagcttttgtgtgtgtgatatgacacagaaattataaaattgtagtcactaagtggtcagctttattttatcttagtttgaggggaaaagactattccagcattaatactgtgttttcattttgtttaataaagagaagagaactgatagcaatggcagagtgtattttgtcaaccacaacactcgaattacacagtgggaagaccccagaagtcaagggtaagaacttcattgtatgtgtggcttctagagattgcctacctacttttgactcatttatgtattctttcctcaaaaacctcaagcactaatcatctacataccttggaagaagaaaaaagattgcttttatgtaatgaaaagcttgagtttcatgagaatgaggtgggaatgagttggtacgactcactggttttcctgtttctaaaccaatagaattacagaactaaaaaaatactcttgtgtttgttgtagactctcaaaatatgtttatgtggtatatggtataatattttttacattataagaacttgctggttaacatactaagaaatattatcacaagtttgcctttttgatgctttgatgacagtatacaatgatttatgttattctgtgtacgaaagttagctaaggccttgttaaaaaaaagaccactcaaacaaaataattctcaggccagacatagtagcgcacacctttaatttcaccacttgggaggcagaggcagacagatgtctatgagcttgaggccagccagggctacatagtgaggcactgtctgggggtgggggagattgtctgtttctgttttcaaacaaaagcttacagtcttagagttctggaagctggaagtcagaaaccatggtgtcagcagactatatgcctctgatggccagggggaagaggtgctccagttctcctaacctagtggtccacttcctcctcttccctgtcttgttttctgaggtaaggtctctccatgcagctcttgctgtcctgaaactcactctgtagcccaggctggcctcaaactcacaaagattcacctgcttctgcttctcaagtgctgggattaaaggtgtgtgccaacaccgcccagcaaatagcttagcttatggcttttttttttttttttttttttttttttttttttttttttttgagacagggttttactgtggctttggagcctatcctgaaactagctctgtacaccaggctggcctcgaactcacagagatctgcctgtctctgcctcccgagtgctgggattaaaggtgtgcaccaccaacgcccggcttagtttatgtttttaaaggtatgctttgaatttgaaatacctgtttctaagtaccagcaaatattaattttttatacaactattatattaacttaaatatgttcactttcataaggatgataaagagctttaaggataaaacatttgattccccagtaaaattgtatctgggctgcacatgaagctcagtgatacagtgcttgtctaatatgcatgatgtcagcatttgatatctaacatcaaatccatggctttgatccccagtacccctgggtcaggaatgaggatgtcttctctttcaagataaactgaacaagtcacctttctgtcacttgttgctgctgttgttttgtcccttttggacttgataaagttttagagcttaaattagagtcatttcatgaactagtgaccaagttctaccagttcatttgtttaaaatactttatttaaaaagaggtgcttataccccttaatgcattaatctattgactgaatagcataggataatttaccaataccatatgccaatttgtcttagtttgtttttaagacacttggttattgggcctatctagcacctataatcacagtggaagtgaaataccttttttatatttttggttagtcttccctgacatgtgtatggaattatatgaataagactaaatattcttaacattttgatagtttgtaaaattgatttaaggcagtgttcttctaaagtacacttgaagaaaacaacagtccaaactaatagtgtttctctataatagtgagcttgactatctccagatctctgcttttcttcttgtgtgatataaacttgcatatttccagtgttccctcataccaagcccattagataagagacttcaagctataaaaccaggagtgaggggggagggcatagctcagttggtaactctgtcagcctctaccttcgcctctgccactccacctctctatgcctctgcttctgctcttctccacccatgtctctctgccccgtctctctgttccctctggctccccctctgcccctctctctctgacccctctgcctctctctctgccccactctgcctaacctccctgcccgcctgggcctctgggccccctcccctacctcctgggtactgagattaaagtcatgtaccaccacatctggctgttgactacattttatagataaaaagcctgaagtttaaagtttaaagagttttcaggcataaagatagatgttaaggaagaaaatagggatatttcataatgaacttttaagttgccttaacagagatgatagatttgtcagtgggggaagatgccattcagaactgttacagatatgacttgtttgagaacatgatcactggagaaatctcaggattcctgagagggagtctaaaagagaaactgagttaatgagaggtctgttttatggagatgctctgtcaacaagattgatatgtaggcctgagtgagtctaggagcagcagaactatgtaggtatctgtttggaaagtttagatgaagaagaccagaataacggtgggaatcaaagacagagtgggggatcttaggtaccatggctatttgaggtgagtcattaagtagatgggagagtaatataatagtgattcatttttaatgttgttgatgattactttaatgtgtttgtagaatgcctaggtagagatgtctattatctgaaaatgtaggaccatgtagattttctgaaagattttattctgtttacaggtatttatagtttctgtttttggcaaagaaacaagtctttaatatatttgtttatattttcctctgtattttatagtcaattaaatgaaaaacccttaccagaaggctgggaaatgagatttacagtagatggaattccatattttgtggaccacaataaaagaacaaccacttacatagatccacgtacaggaaaatctgccctgtaagttttctaaacattactagttaaaagcacaactaagttcttggattttgacaaagatttcagtaagcaaagattggaggtgtgcttgagatgacttgtccataggtctctgaatactgaatcttgttggttttatttgtttatttgggtgtggggcatggtggggaacaggttctctccttaaagctctggctgacctagaattcactctgtagactaggctggccttgaacttacagaaatcatctgcctttgcttctactagtattaaagaggagtaccactatgttcagcttaagagttctttatatactggcaggagtcacttgatacattatgagaaaggcaccattgggtgagcattgaagactatgctttcacaagcgtagatggattaagcctgctatatgcctagactatatgtcatgtattacttagcctaggtatgatctagtattcctaaaatcgtgatggcccaaacacaagattaaataaagcactggaagaaaatgatgcaatcaagatacacagtaagcacaaagtgtgtgatgtttagcctgtataatatggctgcttcatagtaaactttgttgttgttgttttgtttttttttgatcatttgagacagtctgactatgtaaatctggcagtgtagaccgggttggccttcaatttacagaggtatctgcctctgctgcataagtgctggaattaaaaagtgttccttatcgtacttggctgaactttttatgttagtagaagtatactctaaaataatgattaaaaatggagcactaagggctggagagatgactcaatggtttagagcactggctgctcttccagaggtcctgagttcgattccagcaaccacatggtggctcacaaccatctataatgagatcttgtgccctattctggtgtgcagacagaacactgtatacataataaaaattctttaaaaaaaagggggggggcggcactaagccggatgtagtggtgcatgcttttaataccagcactagggaggcaaaggcaagtggatggatctgtgagtttaaggccagcctggtctacatagtgagttccaggacagacaggactgttatacagagaaaccctgtctcaagaaaccgatatatatatcagtgggtgtgtgagagatgacacacaatgcctcagtgggtaaaggcacatattgccaagccaaaggacctgagtttgatatccgtgatccacatggttgaaggagataactgacttccacaagttgtcctctgacactggagcactatggtatgagcatgactatacacacaaaataaataaataaataaataaataaataaataaataaatataataaacatgttaaagagagggagagctgggactatagttcagttggtaaataagtaagtagattgaattgttttttctttttcattttattggaagaagattgagtacacttccagtgactaaatagtaacaaagggattagaggtattgctcagttagaataatgcatgcctgcatgcatgaagcccttagttcagtctccagtatcacatgcatccaggcatggtggcacatgcctataataccagcatttgggagatggagatggaccaaatattaaggccagcctgggctacataagaccttgtctcaaaacaaaagtacaaaaagattccactcagtaacaagagtactgccctgcagccagttatgtggttttcttcatttcttcttcagattcattgttaatgtgtagacatataactaataatgtgttaacatattctgatactttgttgaatttctttcttaaggtaattttcaatttctgcatataagattttattatctgaaaacaaatcattatgtattcccagtctgcctcctttttcttgcctagttattctagctttaattcccaatactagacatccttgcattgtttctgacctgatcttagagaggttttcataccttaactattggttgtaatattcttgttagatttttctcctttcttttaactaaaaaatatttttcactttgtgtggtattgcacacctttaatcccagcacttgggaggcagaggcagacatatctttgtgagttcaaggccagcttggttcacatagccagttcaaggacagctaagactacatagaaagatcctgtctcaaaaaaacctctgtgtgtgtgtgtgtgtgtgtgtgtgtgtgtgtgtgtgtgtgtgtgtgtgtgtgtgtgtgtgtgtgtgtgtgtgtgtgtgtgcccgcgcgcgtgtgcacgcatgcacaagagagacagagacagagaccatggagctggaattacagacatttgtaaaccacctaaccagtgtgttaggatctgagctctggtcctctgatagcacaggaacttcttaaccactgagtcatctctggccctttttgttatgtttacacttgattgttacatgatttcatatgttgaactacccttccattctaacaaattccatgcggtatgtgatataaaggattaaaacatcaatcctttaatattctgtcaaaatccttttgcatatatatatgtatatatatatatgtgtgtgtatatatatttatttattttggtttttcaagacagggtttctctgtgtaacagctctggctgtcctggaactagctctgtagaccaggctggcttcgaactcacagagatctgcctgcctctgcctcttaagtgctgggattaaaggtgtgcaccaacaccatgtggcagctaataatatttgactgagaattttatatttctgcatattaaaagcttgcctgtttacacagaaactgagaaatcagtccaattaggcaccaatgaaaaattatagaggtaatcgagctgtgccaataaattataagtagataatatagttacaattaagtttgggtgcatataacagaaagtcctacaacaataataccttatatttgaatagtagtatatttttctacattatttaaaaataacctggaccagataatgatgttttcctgtaatcataaccacctgtaactcaagctctgtgagattcagtgccctcttctggcctcctctggcacatactccctcccctagataattaaatttaattaaaaataaaagtgtaactcaccataaaaatagaatagcagaggaaaatgtatgaccattatgtctcagtagttaagagcacttgttgcacttggagagaattctagttcagtttctgtcatccacatggcatggaacaataatctgtaaattcagttccagggtatccagttccttctcagccctcgttgggcattgggcactcacatggtacacagtcacacatacaggccaacactcttacatcttttaaaataagtcatgatcattttatgatccactttcacctgccgtggaaatgttcttacctacgaaattacagacaaaagcctcagtcagcatcatatttaatgatgaagtaattcctccacaagaacaagggtatctatcagcattactgccactcatcatcataccggcaatcaagtgtagaagagacagtctgagccagcgttggctgcgcatacctttaatcccagcactcgggaggcagaggcaggcggatctctgtgagttcgaggccagcctggcctacagagtgagtgccaggataggctccaaagctacatagagaaaccctgtctcaaaaaacccagaaagagagagagagagagagagagagagagagagagagagagagagagagagagagagaaaaaaaaaataaacagtcagtcagtctggagaggaggaagtcatactgtttttaagaatcatatgtagtgaaagtaaaagggaatatagagaaaaccactagagctagtaaattttccaagattgcagggtacagaatcagatggaattcctcattgaaacaccagacagaggcttccggtgatctggagttcttgttctacagccctagagcagggtttccatcctcattgtgcttgtcatttggagaaaggccacactggaatgggaaacagcaaaaccctgaaccaatgtctcttctcttttaaaaattgacttgttgaaagcccctacagcagttgtcattagaggtccttagacagacccgaagtctcacacacacactaggtagcatccacttggttgaccgtgagtctcagttaaggataaaaggatagagtagtaaatgtgatgggttacatttttatgtaggagctcttttatccagccctgttatattcacctacatatagaaaaaactcccctagcagtagcgtcaacaagattttagtaaaaatagtcctgaggaaacattcaaaacagaaaagagttgtattaggaatatgctctgcctggttcctttgtatttgtctgctgagtaatgggtcaaaacaggggtggggagtggctgtgtttgctttcctgcagcatttcttttacaagcagttgcatgtgtcatgttaatctctgtttttccagagacaatggacctcagatagcctatgtgcgggacttcaaggcaaaggttcagtatttccggttctggtgtcaggttagtgttggctctgtgtctctaaatctctttgtttgtttgtttgtttgtttgtttgtttttctagacagggtttctctgtgtagctttggagcttatcctggcactcactctgtaggccaggctggcctcgaactcacagagatccgtctgcctctgcctcccgagtgctgggattaaaggtgtgcgccaccaacgcccagctctctttcctcattttacattgcttatgttataccgcggttctgcaaatatgtatttacaagaaaaatgtgaagcattggactcatccatttttaggacaatgaaatatagttttcaattagataattgtatgctttggacacaaagattgagctagaaatcatttgaattgagaacatttgactttttttcatcagtactattgttttcaagttgcataaatctagcaacaaaatattttctgataaacagattgcaattggccccttatctagggtgtgtgtgtgtgtgtgtgtgtgtgtgtgtgtgtgtgtgtgtgtttgagacaggacaatctaaatagcccatagtggctttgaacttaaaatcctcctccctcagccttctgagtgctgcaattataggtgtttgcctcagccataactccatgtagaatgtttgaaatgtctttgataagtacacatgtgatcatttacatacaaatatatattcagtgtttttttctgatgtctaaagattttctgtatgggttctaaataaaatgagtgcattaattgaactattatgttaaatacttaaattcaaatttttataattaactgggaaacataattctggattaaaaattgaaaattaaagacttacttgagtccttaaataaatactttatatatctgattttcatactttacatacagagatctgattttctttttactctcattgaaaagaatcaatgtgagtgctgacagatgtgttggcaatcatggtatacattcatattcaaaatctgtttttatttgcaaagttaaaagtaagtaaaaatttccttttgggtttagctaggccattttaatggtgagagttgatttaaattgttcttacataagggagaggggagggaaggggaactggggaagttggcatgtaaaattttttttcaaataaaaaaatatttttaaattgttcttacatttcagcaactggccatgccacagcatataaagatcacagtgacaagaaaaacattgtttgaggattcctttcaacaggtattgtctcgttcactcagtaatgactaccttctgatattgatgatttgctcttaatagtttagcttataactttagtgtttgtgtgtgtgtgtgtgatatgcatgctcatgttcatgcaagtacaagtgtggaggccagagacgtacgtcggtgtctcactccctcactatctaccttgtattttgagacggcacctcactgaacgtggagctgacatttgggctagagcagctagccagcaaacccttaggatctgtctgtctttgcccttctggtgctggggttacaggcactgtcacaacaaacttctacatgggttgctggagatttgaccacgggtcctcaagcttgcacaggaagcactttactctcaagccatctccccagtccctattcttgatttttcagttcaattttgttgccagctatcttagtacattgcagttgggagtgtgcaaatgctcttgtgcagggttttctgcttctcagtgtaaatgatgactgagtttcaagttctgtgtctaagctgctaagggtgtgatctgaaatgatacacagtaaaattacaatccgtcactagaaagaggtctggaaatagccatgtgcacatgtgatgagtagggagaagagtgaagagtttgtttttacactttgtattactttggatttttttttgataaacatttgtttctcttagaagtaatatattttaagtaggaaagaaattagccattggtttctaagttttcattttcatcagtgaatgagtcagttcactatctttatactgcatacatcactatcaagccaagtgcaattaagtgttagattgtcttagaataaagaaatggaattttttaaacagcatcttgctggtctttgtcttactactagatgtggaaaggatggttttccagcacctgcagtacattgtgataggtgggttcctgagcactgaactaagctgaaaggaagaaaggttcaatccattggccttacctggctgcttcatttcaggaagagttttgttccttttttaatggaaccttagttattaaagagacaagtcagttgtcatcctgctatataggaattaactgaggtacttagagaattctgtgtatactcatggcctgatgtatgtaagcctccatggccatcctcagcctagcgcttactcattcctagtcctcatactcatgattgttttttttttttgtcacttttttatttttttcaattacaactccctagtagctgtagtaacaagatgcagaccatgcttaagcaagccttttatctttatgctcttacaactaaagacttttgcagtgacttgatgatgtgctagaacatttaaaactcatgttagatttgacatccaacaaataaatgggcacttgtaagagaaaatatggttgcttaaaggtaataaatctgatatcaaaataagatgtaatttaaaagttagcaacaggctttcttcatagatgttggataaaattgtgttaaatggtgttttttataagcatagtacaactgtttatggtggaatgtgtagaagaaaaaaagtcccttcccattagcacttgttaaagggaattgttcaaactagttgtaaccttgtgacatctctcaagtttgtagccaagtgcctagttcatggcacatgtagggtgtttatcataaccatgcagtcacaaccactgaactttttgttagaactggctgtactattttgagtgtccgtgtctctttcgtagggaactgagagaacttaccaatcctctttggatatttattaacagtttattcttatcatgtgataaagtatagatatcatatcaaactatcccttgcaggcccctatgggattctcctaagcagaattaaataattttagcgaaggagaaacagattgacctatctactgtagctttgtaatgctgctgcccttgacatctaaaaatgacactgttatccacccactgtgggaggcaaaggagtagttttctgtataattatatactccctctgtgtctgtttccaaagataagtaagtctgcagccactgttaattagtatatgtatcttttgactgtgaaacaaaatcaaagctaaccagtcctactgctcttccctatgttactggaattgaaggaaaatacccaatccatgcctagagttactttgtacactacacaattgatagaacaacttataagtttcatgtagaagtgtaataacgtgtataaaaaatagatgcttatcctaagtatatgaaacattaccataatgtatttctatatatgtgtactatgaattagattgtaaacattctgtttcatgtggaatttaagttacctataatggagtaagtggaaagtgacagtgatgtttccacagttgcagttacagttctctcactttgttttgtagataatgagcttcagcccgcaagatctgagaagacgtttgtgggtgattttcccaggagaagaaggtttagattatggaggtgtagcaaggtagtgatatatgaatactcagaacttagtcctttcttccaaaggtatcattacactttgttcacagtgttattttctcaatctaatatttcaggaaaatgacatatagaaaaccattgtagctttattatgctgcaactacagaatttcaacaaacattaacttagtgcctattttctaagaactgctggttgatggcacctacatcattcacattgtcctcagagtaactctatgggatacgattttacagatgatgagatttagagacttatctagggcacataagttgtagccagatgtaagttttcattttctcaaacagtgtcagtcaaccaacttctgtctgttccatgtattacctagagccctgaagtgtcaagtccttctcactagaatactgagaaagttgatagcgactcagttcctacctaggattgacttagtgctgagaacatagaggactatgagaaaattgctgaatgtctttgttctgctctattcattttggagcaactattcagactctagaagacatccttgagcaagagatagctttgcttatcccatgacagtattacaccagtttaaaattttaaactaggactaggcagaagtggtgcacatctttaatcccaggcctggggagacagaggcaggtgggcatctgtgagttccaggccagcctggcctacagagcaagttcctagacagactccaaagctacaaagaaaccctgtctcaaaaaccaaaaaaataaaaaattattaactagggccacatgatggctcattggataaaagtgctttctacacaacctggcaacttgagtgtagttaccaaaacctacagaaggagagaaaccagttcctcaaaactcttgtgtaacctccacatgcacaatatggcctttgtgtactatgacctgcacatacatacatacatacatacatacatacatacatacacacacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacactcacatgcagcacacatatgatgataataaacaatagaagaaaaacatatttaaaactaagtaggtaataaaattttaagcacatgactaatcccagcactttggaggtagaagtagggaggatctagagttcaagtttagcctggggtacacgagactcgttctcacctaaaatcaaataaaaataaattacaaagcagtagcagtgtggaagggcaagaattttaaggaaagacagcttgaatatttttattattttgagcaaatacctgtttctagattattatgaagggtagaaatattttgggtttttgttttgtttttaaaattctttagatttatttatattttttatgtacttgagtttttgcctatgtgtatgtatttgcctggtgcccttagaggtcagaagaaggggttgctttcctggaagtggagttagagacagttgtgagccaccatgtgggtgctgggaaccaaacccaactcctccgaaagagcagccagtatagatagatagccttggctgtcttgaactcacagatatcctcctgtctctgcctgatccttctgaatgctgggattaaaggcatgtgacaccatgcctgactgaaaatactgtcttcaagattttttttttaaatatgaatctttgtatatgctaactggtgagtacatcttactagtcactttttttttaaagatttattcgtaattatttgtgtatgtgtgtgtgggatggctacttacacatatgaccgaagtgcttgaggaatccagaagacagcattagatcccttggacgaaagttacagccagctatgagctgcctgacatggtcctgggagctgaactctagtcctctggaagagcagctggtgttcttaaccactgaaccatctctccagccagagtaattttttatagcttaataaattctaaaatgcagttaaactatttaaaaatacatgaagtaatctgaagtaataaatgtaaacaagtaataaataaaataagtgtctgcagacagacacttagatcatttaggagacagccaaatcactcataatcagaagaatgcccagcagtatttatatttgccacattctcaccaaaggttgtgcgctaacaggacaagaggtctaggatacatgctgatggcgcaatatattgggccagatagacccatccgtgttacatagtggccataacttggtgttttcaagtcacttagattagagcttcagggtggctgtgagatgattgttgcacaaacctgtcgaccagagttcagtccccagaacccacataaatgtagaaggagaaccaactttgactcctgaatttatgtgcctgtccctcctctctctctccttccctctctgtcacagcaagaataaacttctcagggcattattctaatagatgagtggctggaataagtgttttccctatgaaaatgaggtgtttggcatagtggctctccttaagtattctatgagacttaattgaagatggaatcagaattgtaattcagctgctctaattacctgggccaatagtaaattttaaacttgactatataaaattttatcaactaacaattttcacattttaatatctttgaagttagggtgcatattatgattgtgattagaaaaactttagtgggcaatcaagtaagggtctttaaagttaatgatatcttagatcctttgaaatttgagagcatataaatatcctgtgtaacataatgtagtttgaacagaatcaagaaaaatcaacaagaaattagaaaagcattgcagttgaggcaggcagattcctgacaactctataatgctgctctgttatttgttgacttggtttcctacaagacttttcatcctgagttttcttttgatttcagagaatggttctttcttttgtcacatgaagtgttgaacccaatgtattgcctgtttgaatatgcagggaaggataactactgtctgcagataaaccccgcttcttacatcaatccagaccacctgaaatatttccgctttattggcagatttattgccatggtaagtacaggtgtaacactgcacttactcattcagcaatactaaatttttgtgtattacaacagattatgtgacagagtccccctccccccttttttttaatattttttgtttttgtttttgagatggggtttctctgtgtagccctggctgtcctggaactcacaatgtagaccagactggcctcaaattcatagagatccacctacttctgcctcctcagtgctgtgatcaaaggcatgtgccactaccacccgtcacgacagaatttaaaatttttattttgtctgtctgggtgttttgccttcgtgtatgtctgagcaccatgtgaatgcctggtgcctgtggaggtcaggagagggaatgagatcctctggtacctgagttacagacagtagtgagtcaccatgtggttgctgggaattaaacctggttgtctggaagagcagccagtgctcttaactgctgagccatctttctacctatagaggttttagagaagtgaggtcttcatcgtgtgtgtgtgtgtgtgtgtgtgtgtgtgtgtgtgtgtgttgtgtgtgtgtgtgcgcgtgcgtgtgcgcgcgcgtgtgcgtgtgcgtgtgcatgagcacacatatgtatttgcttgtttgttttgtttttgagggaccacctccatacatagctttggctggcttgactatcactgtgtaggccaggttggtctccagttcctggagatctgcctacctatgtcttggagtgctattaaagacatgtgccaccacacccagcctcaacaattttttgaatggaacacttatctaatgttttgatgtttaatgacttttatatggttatcttatacagtattgcttccttcctgtataggctctattccatggaaaatttatagataccgggttttctttaccattctataagcgtatcttgaacaaaccagttggacttaaggatttggaatctattgatccagaattttacaattctctcatctgggttaagtaagtttctttttacatttattaaaatacaatccatgtgctttcattgtggtactagtgaagttttccacattataaccatgtcattgttttatcgaatttaaatgatatggacatcaaacctttctcatgttcagtatgataaattttatagaagtgtaccctaggtcttaggtaatatgattctaatattctatttctttgaatttgttgtcataatttaagggttattacttaaattcagaaggtgaatttaattaaacttttgaattatgattgatatgtacatataaaaaataatgcctatttcaattgtgcagagaaaacaatattgaagaatgtggtttggaaatgtacttctctgttgataaagaaattctgggtgaaattaagagtcatgatttgaaacccaatggtggcaatattcttgtgacagaagaaaataaggaggaatacatcaggtaagagcagtgtccctaaaaggaggcaagaagagtggtgcaaacggggatggctcaacagtgaacagtacttgcttctcttccagaggaccctaagtttgttcacagcactgacatcagacggctcacaaccatctggaactctagctccaggggatcaacacttctgtcctctggacactaacacacatggcatacacaacatacacacaaaaataaatattctttttttttttttttttttttttttaaaaaatgaggcaacgttcctttgacagagtttagcctttttgttaatgattgttaaataatagttaaaaggtgatagtcaagcaaagctcactaggcctgtgtgtgtgcttgcgtgtgtgcttgcgtgtgtgtgtgtgtgtgtgtgtgtgtgtgtgtgtgtgttggggggagcctcataatagatcagtagattaaaaaacaaacgtgagcctttaacgtgccaatcaaccaccttgaccaaattgcttttttcctcttgtttttctacttgatacttttgggtcagagaacattctttaagatgacattctgttttgaaacttgtgttataagccagtatgtggtctgtcttttgcacatatgtgcttctatttctgggttagttattgtcaagaactcaaatacctaaaatatacacctttgtttgcttgttaaaattgttttaaaagaaaatattctgaaacaaaataaaatttttatatgattttaactgttgaaagatgtagataagaattgaaatctggggccgggagttggtggtgcacacctttaatcccagcactcaggaggcagaggcaggcagatctccgtgagtttgaggccagcctggtctccagagccagtgccaggataggctccaaagctacagagagaaaccctgtctcgaaaccaccccccccccaaaaaaaagattgaaatctgcaaaattttttggtaaaaagagtttaaagaaaataattccctcaaaaaaaaaaaattttttttcgccgggctttggtggcgcacgcctttaatcccagtactcgagaggcagaggcaggcggatctctgtgagttcgagaccagcctggtctacaagagctagttccaggacatcctccaaagccacagagaaaccctgtctcgaaaaaacaaaacaaacaaacaaaaaaaatattttcaaacatggcatggtgatgcttacttgttatcatagccattgggaagctgaggcaggaggattgccttgggcttgaagccaggctgggctatatgatgagttacagggcagcctaggttacattgtgagaccctctttcaaaaaaaaaagacgttcatgctactctaatttttatgtctatttcagggttttagaataatgtttacaattttaattttatatgtagaacttaaaatcttaacttcctaatacaatttccattcttacttgccaggatggtagctgagtggagattgtctcgaggtgttgaagaacagacacaagctttctttgagggctttaatgaaattcttccccagcaatatttacaatattttgatgcaaaggagttagaggtaatgagcctttcttttcctccaacacgctagtgaatgcccttgggtatctattttaaaaccagtgttttcatctttctagtggaatttgtgtttttttacgataacaggtgtttgaaacgcccttaatttatactgaaagaaagaagaacattacctgagaaaaaactgttgttgcagctagagaggtgacaaagggttatgtgccccgcctgctcttcagaggacctgagttcagttcccagatcccagggtaccaggctgtctagaagtgcacaaacacacatatagacaaacatccatacacgtaaaataaatcaataatatttttaaaaagtcttaacattaggtttttctgcaattcagtaactatttctctcaatatgagaccccacacatgggagctgtcctccctgggtcgtgactaggactctgagtcacatggataggacatgggggtttgggtttactgagacttgcttagtgtatcttcagtcactgtttcatggcagtcttatttaggagaaacaattttggttacctaaagtaacaacttgctttttgtttttgttttattcatataggtccttttgtgtggaatgcaggagattgatttgaatgactggcagagacatgccatctatcgtcactacactaggacaagcaaacagatcatgtggttttggcaggtttgtttctaaatttatttttatagacagacacagtatacatttgttttattttttttttagaatttaccaaaataagtgacataacaaaatgtaaatttttgtcctaaactgtgcattacagtaatatgttataatgagtgagtgtgatttttacagaatcctctaaagactgttactgagtaacacgtaccttgtacttttgccagagtacaagctaatttcagaagatatgattcattcatttaggggctagagagagttccattggtaaagagcacttgttcttgcagtggttcccagcactcatacgatgactcacaaccatccatagccgtgtgttctgcacatacatatgcatgcatgcatgcatacatacatacatacatacatacatacatacatacatacatgtgctgcacatacaatcagtaagtctaaaaaacttgtaaaaagaaagggtcatttatatttgacatcaatacttctggaatcttatggaactataaagtatggctttgatcattgctacttcattaagaattatataatgtttggaaggcagatttagatctggcttagggttgtaggagacctctcaagaaatgcctgctgttgccgggcgttggtggcgcacacctttaatcccagcacttgggaggcagaggcaggtggatctctgtgagttcgagaccagtctggtctacaagagctagttctgggacagcctccaaagccacagagaaaccctgtctcgaaaaaccaaaaaaaaaaaaaaaaaaagaaatgcctgctgtcaggctgttcagccaataaagtgctcactgtggaagcactggtacctgattctgaacacccacttgggaaagcagagccagagacatgctcctaacctcagtgctggggaacacagatagaagaccctggggactcagtggccactccagccagtaagtgagctctgggttcagtgagagaccatgactggaggaaaaaaaataaaaagctggagaatgatagaggaaaattcctaacattggcctctgacctcaacacgtactcaaaaatgcatgcacacaccagtctacacaggtgtgcaacatgtgccatcaccactaccagccaactaaaagcataagattgagggcccaaaataaaaaaagaaagtaagaaagaaaagaaataatgaggaaaaaagaaagaagaaaaaagattgagggccaaagagttggcttagcctataaaggcgcctgctgccaactctgctgacctgtgtttgaaccctcagtttcaggaaagaaccaccttctgaaagttgtcctctgtcctccacatgcactggggctctcttgtgcacacactcagtgaataaaaatcttaaaatagccgggtgttggtggcgcacgcctttaatcccagcacttgggaggcagaggcagacggatctctgagtttgaggccagcctggtctccagagcaagtgccaggataggctccaaagcaatacagagaaaccctgtgtcaaaaaacaaaaataaaaaacaaaaaatcttaaaataaaatggggctggagcgagagcctagcaatttagaatacttgttgctcttgcaaaggaccctggtttggtcttcaatgtccacattgtgctcacaaacatctgagcttccaatttcagggaatctgatgttctcttggacatccttcttggacactgtacacatgtggtttgcatacatgaactcaggcaaagacacacataaaatgttactttttttcattttttttatttaaagggaactgacaagatggctcagtgggccaaggcacttgccaacaaggatgaatccctaggactcacttggtagaatgagagaacaaactgtggaatttgtcctctgactttcatatgcattggtatctacctgttcacacacagccacacaaaaacaagtaattagaaaaataaacagggcccagcactcaggaggcagaggcaggtggatctctgtgagttcgagaccagcctggtctacaagagctagttccaggacagcctccaaagccacagagaaaccctgtctcgaaaaaccaataaataataataataataataataataataaaaaatagggtctggggatatggctcagtggttaagaacaacacttggtgctgttctagaggacctaagtttggttcatagaacccgtcagtgactcaaacgttccagggtatttaatgcctctgacctccacaagcacgtgtattcacatgtgcctacctacaggtagacacacttgcctatacatcattaaatataaatggtcctaaaaataaataaaaacaagtcactgatgctcaaaaatctttaattcttaaggatatacaaattcaaaccccgctagataggagtttgtacacattaggaaataggagaggcataccctttgatgagcatgtggaaaacgtgaaaccttcatttctgttaagagtgtaatgtactgaaatgggagatagtgtggcagctcaccaaaaagttaactgtagccaggctcggtaaccatatccctgtaatatcacttgggaggcaagaagattgatcaggagttgaagaccagcctcagctatatgagaccttgtcttaaaaacaagaggccagcatggtggcgcacacctttattcccagtgctcaggaggcagaggcaggtagatttctgagttcaaggccagcctggtttacagaatgagttccaggacagccagagctacacaaatcttgtattgaaaccccccttgcccctccaattaaaacaaataaccaaaacatggacagtttaaatatacagttaacatacatgatttaccagttttacttcaaaagaattaaacctgaagacccaagcagatattgctgcatgccagtatttataggagtgttgttccagcttacctaaaggcaaaattaacctacctgcattttaatggatgagcaaacaagaaatgatgagtacattaatggaaatcacttagcccttaaagtgaataaaacaaaaaaaatttttttaaatgaatataacttgtgagtatatgaattttgaactgggcatggtatctcatgcttgtaattataggtctaagcccagtggctctcaaccttcctaactctgtgaccctttaatacagttcttcatgttgtggtgactctataaaattattttcattgctacttcataactaattttgctactgttatgaattgtaatataaatatttttagagatgaagggttgccaaggggttgtggctcatagatttgagagccattgtcttagaggctaaggcagagggattatgagttcaagagaagcctaggttacttagcaacgtgtctcagaagtaggaaaaacatgaattttgtgctggaagtatcacttagttaacatgctccaggccccaaattccatcataagcactgaggctgggggaggggtgttcagaggataatcagggctcagatgcagagcacttcccctgtctacacaggccctggctcagccccctgcactgagggaaaaaagcaagttttgaggcctggcttggtggcacacatctctaatctcagtcctcaggaagttggaggaccattgtaagttcaaggccagcctagtctacatgatgagccctgagctgtcatccttctaccttccaccacccaggtgcataggcatgtgttggtttttaaataattgaaaagttatatgcaaaaagcacttctttaggtgtagaaattgattgaggcggaatatgggattgaggtaacaggctctgagagttttgtttaggatgatgaaaaaattctcaagatagttaatagtatggatgtacctaatgctgctgtattgtacacttagaattagtaacatggggagctaggaatagggctgagtctataatgtgcttgtaatcaaagtgtgcatgtgaatccacagcacactcgggaagctggacacagcagcacacagcttgatgccagagctgggaggcagagacgggagcatccctgaggtgtcctagccatctagtatagctgagaggacaagctgcagggtccacgagagactgtttcaaaagacacagaagatagatggagagacattgaggaagacatgtaggattgacccccagcctccacacacaggcatttgcatctgaacatacatgtgcacactcatgtgactattacatttgccacacaaagtaacagggcagactctgttaggggtatcttacctcactcttacgtgtgtgtgtgtgtgtgtgtgtgtgtgtgtgtgtgtgtgtgtgtataaatgcacatattgtgtacagagatggcatggtttgcatatggatgcagagaacaacttgtaggcatcaggtctttcccttctatcaagtggcttctgaggattgaacttgagcatcaggcttggtgacaagcaccttgtccactgagccatctcactggtcatttaacacgattttaaaaataaaacttaaaatgtcctctatacatgtaacacaatttgtgttaagaaacacaaagatgagaccagcctggtctacaagagttagttccaggacagcctccaaagccagagaaaccctgtctcgaaaaaccaaaaaaagaaagaaaaagaaagaaagaaagaaagaaagaaagaaagaaagaaagaaagaaagaaagaaagagaaagaaagacagacacaaagatgaagctgggcatggtggcacacacttttttttttaaagattttatttatttattatgtatacaacattctgcttccatgtatatctgcacaccagaagagggcaccagatctcataacagatggttataagccaccatgtggttgctgggaattaaactcaggacctctggaagagcagtcagcgctcttaacctctgagccatctctccaaccccgttggcacacacctttaatcctagcatttgggagtgagaggcaggccgatctctgtgagttcaagggcagcctggtctacagagtgagttccaggatagccaaggctacacaaagagaaaccatatcctgagttgtccccctcatctccccaaaaaagaaagaaactcaaagatgaactgaaataattgacaaccagattggtggctcatgcctataatcctagcacctaggaggctaaaacaggatgattttggagtgtaaggatattctcaagtatatagcaagcttgagatcagtctggactataggctggccctgaacgcacagaaatccacctgcctttgccttcctagtgctgggattaaaggtgtgtgccaccacagcctggctcataagaccccccccctttttttttttttaaaaatgactaaataattgacagtaaataagggaacatatgcattataaaaacatgtgttgctcagccaaaataagctagaggatataaacatttgctagaaaccttatatttctggctgcatgtggctacaaataccttaagatattgaggaaagtggttgttgcatttcataagcttaatttgatttgtccttgaaaccaagagatttattcatactagacctttgtgtcctgagtaaccacaggaacgtgctataggacagtcaagtctaagggggaacaggaaaggctgccctagaaaaacagagccaagagccttcagagatcctatcctgaggtctagtaaaggaggctgctgaggctttgatgggcatggataaatttattatctggtgttgctgacaccccaagttcatttaagatttgaagtgatcatttctctttcttgttcagtgagctgtatataccatgacttaacatttctccttgaatgtaatgttaacagtttgttaaagaaattgataacgagaagaggatgagacttctgcagttcgttactggaacctgccgattgccagtgggaggatttgctgacctcatgggtgtgtataaaggtccttttctgtagagaaggctgttgactttcctgcctttggatgattgtatgtgcaacttaccaggagcaacaaacaggtccacagttgacctgcattttgtggacttggagttgactttagttcttacctcagtgtatttttttcctgttttgtaagacagggtctcacgtcccctagtctggcttcaaactcactatgtagccaaggataaccttgaattcctggcctcctgcctccatatgtatatttggtaaagcgctatggtagaagatatatttgaataaacaaatacctgttcctgtttttgggtggggggaggactacctctttttcttttaacttttattttatttttattttttttagtacattagtgttttgcctgtgtgaagatgtcagatcccctgaaacaggagttacagacagttgtgagctgccctgtgggtactgggaattgaaccctggtcctttggaagaacagccagtgctcttaaccactgagccatctcttcagccccacttatgcctatttttacgaatatatttgagtttaagaaagtaaattctctctaagcactggaaaaatcataaagcatataggaaacagagacatagctgggcttggtggcgcatgccttttatctcagcactcgggaagcagaggtgggcggatgtctgtgagttcaaggccagcctggtctccagagcaagtgccaggataggcttcaaagctacacagaaaccctgtctcgaaaaaccaaaaaaaagaaaaacaaaacaaacaaaaaaagccacttgaaatttattaggagggaagaatctgtgagaatgactgcctctgccagggtggaaaaagggcatccccaaactaaacaggcacagggcttatgtagtgtttcttaggggtggagctttccaaggtggagattttcagagtgaggattggtagatctttttgtgctgagggattggttgaatttcagtccctgagttggttgggacagggtgtgtttccttggctctggtctcagggccaggtgttctttcagtggccctttttaccctatgcatgtggcaggtggcttctgctgtatttcacaatcttctctgttacatgttaattcacatcactgactgcttatctctgtagctcaaatactttaatgaacctttagtcccagcgctcgggaggcagaggcaggtgggtctcttcgagttccaggacaaccagggctacagaaagactgattaaaaagcaaaaaaggggggtgggtggggggagcagtattctgaaatgaatagaagggagcatgcaaagtgaataaatgtctctttagtatagaactccaccccccatccccccacccccgccagggtttctctctgtattgttgtggagcctatcctggaacttcctctggagaccaggctggcctcgaactcacagagatccacctgcctctgcctcccgaatgctgggattaaaggtgagcaccaccaacgcccggcagtatagaacatttttaacagctcttgttcataaccatctttgtttccttatcctcctggattctgtgtgtaactacttgtgagtgttcaaacacaaaagaactacctgtctccgttgttctgggtctagtcattaggatacaggagctctgtgcatggtgcaccatacactgggaacattcagtgttctgtcagttctagttcacaaggccaacaaacagcacccactagcagtcattttgaccaccagtgaatgcttcctagggagcaggcgtgtccttttaataaagccatgcttggtgctgattaacaccacagctgtgtctaacaggagggaggaggcaagcatcattgagggtgagtatgtgtctaaggtcggctgtccaggacctgtgagcaccggccttatgctgaatttgctggctgcttacatgtgtagagtttcaacaattaggtatctgtgtctatgtgggctattattaatcatggcattgtgctattctagctaaggaatgataaatagagctgcagggtttcttcttggtatttgtcaacaaaatgattctcaaatttcaccacttgtcagaagcacccggaagcttgttaaaatgtgcacctaagctcctgcccctggagttgtgatgcagtaggtttgggacaggtctgtgcatctggggttctgaatggcaatgctgctgctgaactcggatgcataatgaagaactttaaatcagcaatttctttatgcttttactgtgctttagggagtaatggaccacagaagttctgcatcgagaaagttgggaaagaaaattggttacccagaagccatacttggtaagcaaaatcagaaatacagaaaataaactttaacaacttagcctctggctacttgttagaaatgaattaatttttccatatcttaacagttttaactgaggcagaatttatgtcttacaaaataaattcccttccctccttttaaaagattgtttttatttgtatatgttgctgcatgaatgtatgtgcgccatgtgtaatttacaggtgttgtgagctacctgattcaggtgctgggaattgaaccctgggtcctctggaagaacaataagagctcataaccactaagccatctgatagctcatattccccccccccccttttattgagacaggacatagcccaagctacccttgaacacctgatcttcctgcctctgcttcccaaatgctgggattacaaaccagaaaactgacccattttgatccatgatatagttttacaggtttgaagttgttttagagccttgccttcaactcaagatgatctcttttgtgcccatttaccattcatgcacctttcctacctctcaaagtgttaacatgggatttagaatacttgtaccttacttagtaatttactgaacacaagtattgctctttttggtttcctttttgcaataccagcaattgagttcagccagggcctttcacattcaaggcagacctctataacagagctatatccccagaccttattttctggtttaaaatgcagtttaacctcattttccaaaatgtcccaaactaaaaagcaaccagtgttaacctcaaatacagttcatgttagaattcagtttgtggtaatcacatttggattttaacctttttcaggtgtgtgtagttcagtgttaagtgggttcatatagttatgtaggcatccctgtcatctgttggctgacatgtgtcactaaacacacacctacactctacagctcttggtgaccagcattctttttatctctaggacttttgattaattcaggtcctttctcagtatggaatctggcccttctttgcctggcttgttttacttcaaatgatgtgttagagtacatatcacctttttcttccttttattttactgattgtgtattttgtgtggcattaggaaacaaaaccaacaccttatatttttgttaggctaacattttgttgttgaaccacagccccagccttcctattacttttaattgacacaaaataattgtacatatttttatgtgacttagtttttgagacaaggtctcatgaagcctaggctagctttgaattcctattcatcctgcctctaatgcccaaatactgaaattatagacataaagtatcttgcttaactatttatggacctatttgctcttgcagaggacctgggttcgattcctagcacccacatgatggctcacaacaactataactccagatccaagagatctggttcacttttttggcttccactggcactaggcacatatgcaggtcatagatatacgggtaaacaaaacacacaggtaaaaaaaataatatatatttgacaataatgtaaatagttccttgggtttttaaaaggtggaattgtttattttatctcacacctataagaacacaaacaaacaaacaaaaagatactgcctaaaactcttaaagctgggctggagaaattccgagctaagagtagaacagagaaatgtagagggagcgaagtattagagggtcattttctgatatttctttgtgttgtttatgttgagacaaggtctcactatgcaaaccaggtggcctcagactcacagagatctgcctgcctctgcctcctgagtgctgggactaaaggcatgggccaccacacctggcctatcacttcttattctaacacgatacacctaaaaccttgtatagcctgcaaagtctaaagtatttctttttggccatttacagtaagtgtgataaccactgatctagagtggttgttagggcagcatgagcagactgtcatttcctgaatgctgaacattggcactgagctgtgtgcggctctgactatctaccacaggggtgggtgttgctatccagtttaccagagaaggcacttgagtgagtcttggaaaggttgaaagcagttcctcaaaggccctgattccagtccacattgtcagaactttaaagtgttgctgcagagcactgctcacatctgtctttgtatccttccttttcttaagccaacaattcttattttcagttttaaccgcctggaccttccaccctacaagagctatgagcaactgaaggaaaagctgttatttgccattgaagaaacagaaggatttggacaagagtaactgttgagaccttaggccaccagaggacagggactcatctacagtgcctgccccttccttctctgcctgttgcacatcttattgtaaacttggactgtgactagagagttatctgagtgtaagtagattaacgttatcactgagatttatcttccagtaattctggatttctactcagcgtcttcagaaagcagatctacaaacagtagtcagaaacttacttaacatgagatttaacacatgatgagatctcccttgtcttattctactagattgttcccttaacaacagttttctgtggtgtcaaagtcccacttgggagttggtctcttggtggctgttgtaaagattctgcagacacaagggacatctccaaagctgcaatacacaaggtcttcctggtaaagcctctagctaggaggcgctcgacaccagtgcaagctcagccccgcgccggcacttgagcaattgccgcttgtgctctccctctcatctcagcctggcctgactgttgttttcatccctggagcatgaatcagtgcgtcagtgcgtcattctgacgttattcctggcagtgacgcaggactcacatctttgtacaaagtagttttgtctatttgaattcagggaaacttggtccccgcccacacatgacttcatacctcttttcattcagtttataattattttattgccttgcaaatactaaactttacaagcagtatcagcactgtggttccttcacattttagaagttaacctaaaattaaaattattttttctgaattcatctaagatcattcttgatttttaagtcttacacataaattgaagctttatggttttatcataatctaataccccagttacatttctaaaccgttggaaccatttctaatccaaataaaggtcagtggtgcagtctttgaagtcaggaccatatcaacaaaatgacagtgcccagccacacctgtatgctgtctttacacttctgccacacacaggagcaggtgtcccatcttctcacatggtcctgatctgcaatatttttctcacccctaaaaacattagattttgctttttttcttcatgacttgtttatttcagactgctcctttagtaactgatgaatgcactttgactttctctgtactcagtttcccttggctttgcttagactgtcaggatggctgctgccatagatacgacttcatgagcagtgaaatgaagcctcagccatgtgagtccctattatagccaaatcccccaaaagccttataacacaaacagggacttttggacacatgtcggtagcatagcacgaacataaagcatgaagccaagaacacacagagagtgacaaacccctgttccataggaaagaaagtgtttctctgtccctagctgctcttcttgttctcaccctggaacattttgaatttgtgcagctgtactctaacactgccatcggtggtcagcggagactctcgtgactgaggaagggttgcctcatctagagaccatcagtgaagggaagctcagcttctcccagccctcttttcgtcctgtataccacaggaaatacatgtcatctctagaagccctagttatctccaaagtaggaactctctgcctttttgttggtagggttaaaatatatatatatatatatatgctattgctttgtctttcagagcgaatgtctgccaactacccatttactacataggcttggactttaatatatggctataaatactaagccttctacaaagacctcccattggatcaaattcttgtactaaaatgtagtcatctaccatatccactagagatttatgaaattaaattaagaaataatgtaagaaaataggctttgttgattctgcataatgcttcatgattcatttagggacctagagatattatgtgaaattgtataaatatcacccaaaaggctttctgccctatatttttaaaatacagaagttatatttgaagtagtcctggccctagttctatagggcttggctatttaatatttttatggaagaaatgtttagttctggaaaaggtaaatgcttgtatatatttttgcagccctggggtctcccaactccatttcttcctttaatttaattgatcacatgtatatgtcttccctgctgtgttaggaaaatggggctggatatcccaagaatcagagattatataaaataatgcaaccaaacagcagacataaatatttaccaaatgctctcacattttggttcagagtgagtatttggaaatagatttactgtgtttaattagtgattttccttaaatccagactaagttgcttttaagacctttttctctgtaagcattgtaaatgctaatcaatcctgttaagtttttttcttactgcatgttacattgaaataaaaacagagtacagtgagcatttgccttttcttttgctctttggtgggttccacagcagagtcaagagggaaggggcttgggtatttgatcagatgaagtgatttaaagccaactgagcagttggtagcagggacctctggtgtagaagcatttaaatttagaagttatttaaataactctttaaaattcaggtacttttgtcaccaaaggatccgatcatctgcctagaagctctcactctaaatgactgcctcagtcaagccctctgtcactctttacttacttggtgaaattacctgaaatgtttttggggtaactcatgtttggggtctaaattactttcactacttcagtggggtatcatgggtatttccagccgccaccccttctgggtggactttggactttcaagtgtctgtatgtgcttccatcaagtcaaccagggactggcacccttgcctgtcccttcgatttcttagactgtgacttaaaatgattaggtagctacacatcacagggaggagattgcctcacttggatttccttaaaagatgtaagagtgtttataataattaaagtttttttgagtccttcgttttacacacttccctgttgtttttgttaggaaaatggcatgtaggagagccttttatgtgacttctttagagttgcacgttgacagcctgcctgctgtgaggtataggaaatgcagatctgctgctcacctgtggctgggtgaggccatctgcggggccacagggcctcctgcctcctactgcagcagaagtggtctgaaggagagagggctcagtcagtcaagggcttgctgcaaagcatgatggacccctggagcagcactaggacagtgaagacaggccaatccctgaagcctgtggccagctagacagcctagctgattagataaattccaggttcattgagaccctgtctcaaaacacaaaacacacccactgctgagtacggtggatagtgtcacactcatgaccacactggttcaaaccattgggtcacaaagcaaacacttaagacatgacagtgggatggagagggtgggatgggtacgtgtgaccagaatgcattgtatctgtgcatgaaactgctagtaagtttttaaagtggagccaggcttggtggttcatgcctttaattccagcactggagaggtagaaactagcaacctctgggagttccaggacaactggattatataccttgtcttacaaacaaacaaaagtcaaacagctggagagataagttcagtggttaagagtgcttgcatcctagtgatggtggcagtgaacgcctttaatcccagcactcaggtagagacaggtggatctctgagtttgaggccagccgggactacacagagaaaaaccctgtcttggaaaatcaaaaaagaaaaagaaaaggtacttactactctaccagaggatcaaaattcatattccatgcccatcaagggcagctccctgtcacctacgactctagtaccaagagatctgaggctgcttctgacctccatgagaccaggcgtgcacatgatgcacatacatgcagggtaaatattcatttattgatttattcattttttttcaagttaggatttccctgtgtagcagctctggaactcgctctgtagaccaggctggccttgaactcacagagatcgcctgcctctgcctcccttatgctagcattaacagcgtgtgccactactgcccacaagattaaacattcataaatcaatcttttttcttcttctaaaaaagactgaccaaactccacaagtctgcctcctcacccatttaagaatacctcattagaaatccaagcgtgagcattggtgagatgattggaggtagagccaagcaagcggtggatctgagattaatcccagggccactgagtacgaggagaaaattactcccccaaattgtcctctgtctgtcacagacttgtcctgtggcattcaggagcccacatctatacagacaatgtttagaaaaacttggataagtttggcaaattgctcattgggtaaagatatttgccacacaaccctgatttcaacccctggagcacatggaaaaggtagaaagatcgaaccaatcccactggttgtgctcaggcctccacacatacccttaacatggataccacacaactgtttagggaaggagagaggatggttgtgtctcctttaaaacccgaaccggcagagggaaacttcaggaagtgggtagaaactacagacccctcttaggttcttagaaggtctgttgctcgctcgtgagtgggttcctgttcatccaagagtggctttatgcaatagggcttcctcagaacttcagagaaataactagaaaatttacagtcatgtctttaggtcactagacagctatgctattctttttcctcatctctaactcagacctgctctatttgacttgcctggtatagtaaaaaataccacacccaaagtgacatcacttcagactatcaatatttactactatgtgctagtcgctagtgactgactatactacacttagagaggaatgatctaaagaaaatagtccaaaatattaataacatccaaagaattaaatggagtgttcaaattagaatctaggattttttttttaaactccagaatccctttatactatattgcaattacaagctgagacccttctccactggcagctcagacatcctgtctaatcagacttccaagtcctagcagataaatgtctctgagtcctcaccacagctgccccatcctgcatccatctggttcgtgtgtaagatgaggatgatgatccatgctgagctaattcctgggatttttagggatcctctggaggtgagttatacgcctaatgtttctagcattcaataaccatttgttttgtttacattttttttttttgaaacagtttctctgtgtagccctagctgtcctggtacttacaggctggcctccagatcagaaatcagcctgcttctgctgcccttaagacgtgtgccaccatacccggcaccatttttttttttgatgtgttttgccttcctgtatgtatgtacccacgtgtgtgcctggtactctcagaggtcagaagaggtcatcacatatcttggagtggagctatagacgactgtgagttgtcacgtgggtgctggaaactgaacccaggtcctcagcaagagtaccaagtgctcttactaggtgagttccccttgtagtgggggatcctgcagagcactgcatctagctagcttgaattctggaatgttaccacataggttttttaaaaaaaaaccttaaaaaaaaaacaaaaaaaaacaaaaaacaaaaaaaccttgattcagtgtcttttacatcatgcatcttgatcccactcacttccctgtcccttgtccctttgcatcttccctctacccctgcaaccactcccagtaaaacacaatttaagaaaaagaaaagaacaaaattaaaaatctcgtcctggaagccacagtatgacatagtcacacagtaaatccctttgtccctgtcaacctggcaagtgttcatttcagtcattggtctggttccaggcctctggtttctactacattactctatcaatgttggccctcactgagactcttcttggatatcctgttgttgccctgtgtcatggagatcctgcagctttgggtctgaagatctggtcctttcacgtatccagtagatggcagatggggtggatgttggagcaggctaagtcctaaccctggttctgggcctgggcagctgcagggttggtctgacctccagttctcccctggcctcaccaccaggatgggctctccagcattgctctggctaatttcacccttgaagcaatgagctaggggtggggcaaattctcctgctttcatgctccaacttggaccatacaggccagctcttctgtgttgcccaggccaggtgaaggggccactctcccaagtgctgaagctggtgaggggcagggacagccctcccactgttatgaccccggggatagctcctccacctgcctcaggctttgatggtcaggggttgacagggagggcaagcataaagggaacggctctcccttgcttgacagacacatcggtgtcacctaggcttttaactggcgtttgtgaagctaccttttgtgatagttaacctttagtttgagacgtttgattcttatccgaattcttcatgaaggggttagaacctgactccaggctcactacttgccagtgttttaacctaagttttctagaaaccaatgttttccgtaaactgtaagagtttcaaaccttcaagacaggactgtgggaaaatgggtcccattttacaggcgagataatagtatggcagagatgtcaagaatactctccaaagaaacacaggagtgcgggggtcagcaattaaatcttacaggcgcagggcagtcctgcccggttgatcccggagcttgctcctgaggtgcccaacttcggggctgcccgtgtgctcagctcatttgggctctcgtctctgcatccatgcgggccaaagggagtttccgcgacggtcggcctccgcccggggacccggtcccaccctgaaagcagacgcggagacccggcgcctcttccgcactgccgctgcggcctccgctggctcgcgtcagcccgcccttacccactggctcctgataggctgcccgagctgtccgtctcggccaagagctgtgcgcaggctcagaagggcggggaactcgctgagcgtcggcgcctnnnnnnnnnnnnnnnnnnnnnnnnnnnnnnnnnnnnnnnnnnnnnnnnnnnaccggaagctggtgtgtgaggggacgccgcggagacccgccctcccgtttgcttgccttgcgtctggggccgtgttgggcgaccctagccaggctggagcgctgccgggggtcccctagacgccgtccccctgcgtcttcacactcggagcccggaggcagccgtgtgggactccaactcggacccaccggcttggcggccgcctgtgggctgtttggtggggaccggcgggcccaccctggggcatcctagagccttcctcccacctgacgagttgtgcacaagttaaaaggccttttccagcgttaaagcagacctcagtctcagggctggcatgatggtgcacgcccgaagtcccagctctgggaaggccgggatttgcacttcagggccagccggagctgtaaacacgaggccgtgtcgcaaaacaaaaacttgaatagaaactgttttagtttaatgtgtatgaataatgttttgcctgcatgtatatgtctctgcaccattagggtgcctggagctggcaggccgtaagagggggtcggatcttttggacctggatttacgatggctgtgagccaccgaattgggtgctgggagtcaaattagggtcttttgggaaagcgttcagtgctttaaaatactgagccatctcttcagcccctcgaaaactataggaaggaaactatacataagaaactgacaaggaaaacagaaagcactgtttctcaacctatgggttgagaccccttgaggtcgcatatcagatacagcaaaatgaattatgaagtagcaatgaaaataatttggtggtggtggtgtcaccacaacatgaggaaggttgagaaccactgacctagaggcaactacttaggcacattgtttttatttgctgtagctaccattgactattcaattgggggttctatgtttctcattacaccacaaagaatgtctccacaccatcaaaacagtattgcttcacgtttgtgtaacgctatctttcacaagacttaactgtgaaaacttaagggactggaaagatgggctcagccattatgagcatttgaagatgggttcagttccttcccagcacccacgtgtctgcttacagaggtctgcaactccaattccagatctgatcatttcttctggcttctgcagggtcctacaggcacatgtcacatatgtgtacactctagcacacatacacacacacataaaatatataatttaaacattttaatagcatatttacagctttaagaaatagatttcagtggaaaataatgtttctcatccatccctaaccccagcttcagtctccttcaggaacagccggtttcttgtatatttatacacgcatgtgtatgccttgtttttaatactgaagtggtagctttctatgatgagtactgtgctgctgtttgcactcataaaatcattacatatttagattaacaaatgaactcatgcagcactgtcatacatagtctttaagaagtgcatgtgctcccttcttgacagttgggtatgcttccttctggatttgtttggtgtgtagggactcttttcctttgttccttttatagcccaagctacttcaatttgccatttaaccaaagatgatctttgaactcccaatccttcatctacctcttcagtgctgggattttggttatgtgccaccatacccagcaacattattgtattgatagataagctgcttattgcacaagactagaacagtttatgcatgtttgccatacagtttcctttatgataaatataaacatgcttattctggtctggagccatggcgcagtgatcatgagcacatactactcttcagaggatcggagttaggttcccaaagctcacaactgcttgtaactccagctccaggaaaccagcaccctcttctggcctcctgggtcactatacttatgtatataaacctacacacataaaggtatgattacaaaataataattatatataacatgtatacatactcatattttcactcatttattctctgttcacttaaaaatatctaccattgccaggcatggtagctcacatctttactaccagcacttgggaagcagaggcaggcacatctctgagttcagtgctagaccctgtctcaattaaaaaaaaaaaaaaaaggcggtaatggcgcacacctttaatcccagcactcagaaggcagaaacaggtggatctttgtgagtttgaggatcagcctgggctataaagccagtttctagacatctagggctgttacacagaaaaactctgtctcaaaaaaacaaaaacacaaacaacaacaacaacaacaacaaaaaaccctatcattacaaggggctgtggatttgaaccctaggatcatacactcacactcattccaaacacacacacacacactttttctaaacctacttcattttaaggctgcatagtagtgtcctatgcccatgtattcatttagtttacagtctcttctccagtgctaaagtaaactgcccttgtttcaacactgctgccagtgtttccacaggatagtgtatattggtgggaactccttgttagtacaattacataaaatcatccatactttgtgttcatttttttctccactatgtaatagagaaaaaacacactttaaaactttttttggttttttgagacagggtttctctgtgtagcgttggagcttatcctggcactcgctctggagaccaggcctgcctctgcctcccaagtgctgggattaaaggcattttaaaagccaacggccggcttttttaactattatgtagtaagtaaaagtaatttatcataaagatgatataatgacattatgctttggacattaaataaaaaccaaatatgaacatcttgaaagatacaccagtgaaaaaagaacaggaaagggggaaaacagtgctgagttctgggattaaatatgtgcaccaccatgcccaaacatgggtgtactaaaatttggcaaaccatttccctggggtacaagctaagttgtttccagttcttaagtcaaagtcataatgctatggtctataatttttgcttgtttagattatttccttataatgataattttcaaaatggaggcaaaaggacccagcccttaagagtttttacagtgtattgtgttgcttccctgggaggttattcacctcaagagctttgacttaatgagaccaacattaaaaaagtgctgcattgctgaaacttttcattcatttacaaggaataatggtctttgtatataggtgtttgtaatttatcttagatttgttttctacctctcattggacacattattttccttaatcattttatgtaatatttttaaagttattttcctgttaaactttgctatactaaagataaaactcaaggtcacatgcctgctgggctatgttctgtcatctacctttattttgagacagccaccttacgtcgtagctcaggcaggcctttaatgcacttgtgtagctcagactggcctgaacctcatcagttttcctaaatgctaagatactgagataccgggtgtggtggcaccagaccccacaaatcctgacctttattggtgcacatacatctaactagagaacacataaccttgcctcctcttcacctctgtatagagtatatttatttcacataatcataagctaaatcagtttaatcaggggtgatagagatgggctcagtagttaaaagtatttgctactcaaccatgagaactaatctttgaacacttatgttgggcagttcacagatacctttaacttcagacagctcaaggtcctgatgccatctttggccctctgcatgcacctgtgcacacagatgcatatattctcaaacaaatgaatcaaagattaaaaacaggctacataattaggccgggtctccacagaccaaaaaataagaaaatatcaagagtccagggcagaaggaaagccacaagttggaggcctgcctgggccataaagtgaaagtcttgcctcaaaacaaaacacacacacaaaccagtaacagactcttagttatttttctagtgtgtgaagaaacaccatgaccgtgggaactcataaaagcaagcattaactgggggcttgcttgctgcttcagtgggttagtctatttctaccatcatgggaggaagcagacaggcatggcactgaagcagtagctgggagctttacatcctgatccacaggcagtgagcaagccaagccagacagacagacagagggcctggcatgggcttttgaagtctcaaagcctatctgcagtgacacaccttcaagttcacaccaacttggaaaccaaagattcagctaactacagaacttatagaagacagtgtttgatttgggcttgtggtttcagagggttagagtccgtgatggctgtgcaaaggcatggcagcaggaactactgtgaacttgcatcttcatctgcaaattggaggcagagagactgggaatggcctgagtctcttgaaacctcataacattatacctccaaatactccaaatattcacacataggagcctacggggccattttaattcaagtcaccacataaacatgttatctattctttattattatgcagtgttctgtctgcgtgtatgactgcaggccagaagagggcaccagatcccaccatgtagttgctgggaattgaattgaggacctctggaagagcagccagtgctctcaacctctgagccattttaagaggttgagtatggtgctgtgggaaggcagaggcaggtgaatctctgtgagttcaaggtcagcctggtctacagaggagttccaggacagccagggctgtacaaaaacaaaaaaacaaaaaaacctgtttgaaaaacaaatgatactgaatgtgtcaagctccacagcccccatagtagtgagctctcagggaatggagcgaacatttgtgtttccctgtttatgtgtatgagcatcacacgtgtgcctggtgcccaaggatgccagaaaagtatgatgaatacggaacttgaattacagatagttgtgagctgccatttgggtactgggaactgaacctaggtcctctctctgcaagagtagtaagtgctcttaactgctgagcttttacttcccaagtgctgggattacagacctatagcacaattggctgactagatattttctttttcctgcctctggcttccaaatgctggggtttataggtggaaccaacaatggccagcaaaaatgactgttttgaaaaaaatacagtctataattccatgttctgtatggctttgttttcatctcaagatttcttgtttctaggaagttgtagccacatggaaaatacttttggtgtcttagtttttgtggaatgtcaatcccagacttttgaggtggttccatggcctagtctcttagctaatgagaagcacacttgcagtggatgtttggtgtttcccgtggccctttcctgattactgggcatttctcctctgtttgcttttgtagatgtcattgcagctggcatcttgtagcattcttttgctctttggggttgtttccataggatggattcccagttgggtgactaggacctacctatagtgtttccccttaacacccagaacagcacctagcacgtactaggaggtcagtaagtctgaaatgaccaggatatcagacatgtatgccacactgattgtactgtcctccacagagccagccctgccctttacacaggttctagatcttagaggcatcaggctgcttgccactttgtaggaggagcctctgcccatccctgcagcatctggcactattgttacaggaagtgggtggtggtgactggattgtcagcctgtcttcccagaaaaacaatccattgtgctatctttagttgttcaggagcccccagccctagcccctttgtcctaggaaatagggaaccattttttctgcaaatggtacccctgtttctaaagaccatctgctttggatgttttgttgtttttgttttgttttgttttgagacatgtagatcaggctacccttgaactctcagagatacacatgccaggctcaaacactctgcctttgaggagcttgactagattttgaacctctggagggggtaccctgagagaacgcatacttcaagaccaggttcccagccatggggtgaggagggaccattaggcttctgtttatgggcccctactgtgctgaccactgtggagactgagtaattagagacagtacctgacacatgtctcacaaaagcacagtcaagggcttgaagggttggaggcacgatcattgattataggcttcatagaagaggtgatgtcttagttggtctggaaggctattgggtttcagagaagaagccttgtaaatttttgggggactggggagagccaggtgtggtggtgcacacctttaataccagcactcaggaggcagaggaaggcaatcccttagtttgaggctagcctgatctacatagtgagttccaggaaagcgagggctatgtagagaccctgtctcaaaaactaaaaatatagacaatagatgtgactgcagatggagtatagatggaaggtaaagtcttgaagtggcaagttagaagagtctaaacaagttccatgtgctaggacatcccaccttgagcagtttctggataatcagaattagtaagccccttcctaaggcacatttcctgtgcctatatgtcaaatgttactctgtctaagatgacagattaagtcaccaggtttattgtggagttattttgctcctttgaaatattttcatttgtgacatttgattcacagaaacaaaatgcctctttgctgtttagggttttttgtttttgttttttgttttttttttggttgtttttcaaatcaaagtactgtaccatatgtgtgagtcatgggtgtctgtactccagaaatagtgtttatagtctgttctcagatagccgatgggcagggaggggataactgcctggtggtaaagagccagaagcagtgctcctcatggctggggctgaagctctttctaggccagtgggggcctaaggagcactctacctgggcttggcccggacagctttggggaagtgccaaatgtctgggtgttactctcattcatctgctgggctctgaagacctaatcttggtctcctttttctggcaggcagaggtggaggaaacactcaagagacttcagagccagaaaggagtgcaaggaatcatcgtggtgaacacagaaggtaggtcctcaatccacggcctgcactcaggagggcctccagaaaacagccacacacatgtcgttgcccttcctagtaccttcataaacccagattcattctagttttgttttgaacatttccaaagttctgatactattcttgggatttttcctcctcttttcgagaggtcttgctgtgtaacctgagttgtcctggcactcaggatccttctgcttcacctctcacgtgctagagttatgggcatgcaccacttgttttagaaatcttaatttcagccaggtggtggcggcggcgcacgcctttcatcccagcacttaggaggcagaggaaagatctctatgagttcgaggccagcatggtctacaaagcgagttccaggaaagactccaaagttacagagagaaaccctgtctcgaaaaaccaaaccaaaaaagaaaaagaaaaacaaaacaaaacttaatttagtaaataggaaaattttttttctcggtttcatttcactgacaggtcacagctgtcaatataatccatgctgttttcagcccttgtgaaaaatctatttctcatgtgataatcagttacttttgtttttgaaataaagtctcactgtcctcaattcacagagatccctttgcttcctgagggctgggtttaaagtgtgcacagtcagagccaggatagtagttggatcactgtattggaggccagcctaggctacatagttccggaacaactgtctcagaaaaagtagcaaaaaaaatcaagtgttttccatcacacctgattgttgttactcttttaaacatgtttaccttgaggttttgttttgcaatttcttcaaaaactttttttttttgcactaagaattgaccccaggcttcatacccattaagcaagtactttaccactgaaatgctccttcagccccttcaagcaaaaatttaaagtgtcagtacaattttttgagacagtatcttttctttgtagtttggactagcctgaactcattgtgtagcccaggatggctagactttaaggcattccttgtacccgagtctgtctgctcgggttacaaacttgagtcaccatgcccaattaagtacggtgctgattaatctgttggtgctactcttggtgctcactagttgggtgttgtgcatccatctgtgataattctgctgtttttgtaggtaattctctggttgatttctttgtgcccagagctctttgagggaatgagcttacttgaatggctagtaagatacggatagtgtgtgaagggaactaggaaacacccacattgtaccaaatcagaggacaggtgctttattccttcaagcagcctattggctctattgacaaaacttgaatttagaaatttaatgactgcttctcatttcaaagccaagaccttttctaagatttatttttgttttctgaatgttttgcctgcatataagtatgtactatgtgtgtgcagtgcatgaggccaaaagagaatgttagatcccctagaactgtagttacaggaggttgtgacagtatatctgcaatgtctgtattcaagaggaggatcatggcaaattccaagctattctggtccacatcgtgaattctaggtcagtcaaggttatataatgagaccctggttcaaagaggtgggggtgagtggtggtaggcaattttttttttttttaaaccataacccattttaccaacaagaaagttgagatagagatcaagtaggtacctggcatgatagcacaagcctgcaatcccagcctttgggagatagtagcccaagagagtcatcctcaattgcatggtgaatttaaggacagcctaaatgacaccttgggctccaaaaaaacaagtggggagcagtttgggccaggccaattaagtgatgtacctagtaggattgttcaagttctgcatggtcaacaacagagtacctgctctcttttgctcccaacacaactaggttagtacagaatgtgtgcttcatagcagtatctattaagattttcctttttcagtgctgtggctcaaactcattgccttgtacatactaggtaaatacccagaagccctattaaaggtcttgggcaggttttttgttgttgttgttgctctgagagcacctgactgtaccatacctagaattgtgcttccccggtaactaaagctgcacagtatttttgaaggaaaaggactgaactaggcatccgtgaggagtatagacttaattttgtccttgtttgaaattcttctgatttttgtttcttgcccaccctccctctgtctctctctcctctcctctcctctctttctctctgcctcagagtgagccactattggttaagtttgctggctcctttacatttgcctactttatatataaccaaactcattgttatctgaaccactaaaagtaaaccccagaaacaactcaaataccaacatcagcagatgcttaacatgttaaccacagatgctaatgagagcgggtcctgcctcgagagaacttattgcctagtgggacgtgggtaaaatgtctactttcctaatagtgtggtgttgggattataactactctaaaggaaaactgcatggtactgggatgtcatcagacttgagggtcctccctctaggatcattcgattttggatagattatagtaggtaccagttatagtaggtagcaggcacatagccaccctcagaaaggtacagctataaagaggcctcatggggctcaggtgtgcacattgttgccatctaggacccaatagcagcacagcacttagggcccacatcagcaccttaaaggcaaatgactactgtaacccgttcttatagcttcacatggctcacaaaagcctcttctgctcggctgctttacatgtttctggtgccctaataaagtaggttgaatacctatctttgacttatctttaggctggtcacttattggccagattcacagattcctgggcccatgtcttgcttcttggatgtgaagagtcacttataccacattcttaagtgtcatagtcacctccagacttaccttggatggagccttctgacaggtcacagccaattccaggaacctgatgacccaatgtggtcatcaggttgagccacattcctcacctccataacagtaggacacccagtaatgtccatttaattgttcagtcttcaaaaagagacttgatacagaatgatggtcattggctggttaattataccagtaaaatcctagcctgagcatctatcaataggggaatgttgaatctagggactgtcttacttcatggactctttctatgttttgttgtgtggtgctgggtattggacccgggtctcagacacacaaagtactctggactatacctccaaccacttagtgggctctttcaaagacagcagtgctcttatataaaaacccactggagtggggaggcatcttcatttatacatggttacagctgagccctgagtcagccctgctaaaaataataataaatgtctcgtatatctggtataagctgacctctttttcttcctccttttcagtctcttctttttgagacagggtctcactgtgtagccctagctggcctttaacctagggatctgcctgcctttgcttccccagtgatgactgagttcaagctttaagtgttgcagaagagtacctctccttctattgcttgaacccagtcaggcagagtgggttccatgctcctaggaaaggagcatggagttgaatcaagtctacatttaaatccttatcctttgtgtacttataggcaggtcaccccattattcagttctcctgttgcctggtagccaatgaagatggtgatcctacccacagaggctccggcttacaaggtcagcactgtgcctgtcctataacaagccttcagtaaacagtagcattggttggtaactgccagcccagcattctagaattagggatgtgagatgagacactaaacagaaaggaactcccgtatattgcttggtttccatttattcttcccacaggcattcccatcaagagcaccatggacaaccccactactacacagtatgccaacctcatgcacaacttcatcttgaaggcacggagcactgtgcgtgaaattgacccccaaaatgacctaaccttccttcgaattcgctccaagaaaaatgaaattatggttgcaccaggtaagggttcttgcacctccatgtttagtttcagaacccatagcaggttccctgtggcttatctggaaagtgtggcatattgttatccccacagcttcaaggtaggcccagagtggggtggaaagagtcaagttgcctcactgcctagccagtatctaggtggtatccaccacctgatcttcagcaggcctcacatggaaattgtagtttcatgagggagaaagacacaaacatcaatactgaatcattctcatcttggtaagaattccttaagaatatgggatatggcctggcgttggtgacgcagccacttgggaggcagaggcagccggatctctgtgagttcgaggccagcctggtctacagagcaggtgccaggataggttccatagcaatacagagaaaccctgtctcaaaaaaccagaaaagaaagaaaggaaggaaggaaggaaggaaggaaggaaggaaggaaggaaggaagaatgaatgaatgaatgaatgaatgaatgaatgaatttgggatgtggaagggttgatcaggtctgcctgggcagtcaacaaagatttctcagaagcaggatgttagagctgaatcttaagggccagggaaatatgagtcagagaggtgggaaagctgtttctatatgaaaaagaatttatagtcctgtctccaacccatgcagtcaactccccaccagcattggagcagattgctattttggctcatcagtgaaaaacttgtctgggtagtacaagcatgcctgtgtttaggccttaggatcattgtcagtgtaatgagatgtttcacacttggaggagcccacaaggatgggaactgcagagggaaggcatggggttgcctcctgctctgccttatctaactcaaactcacagactagagtgactgacgggttctacaaaactatttttctgtggttaccactctctctgtcttttcagccaagccatggctgggacatgcatgagatctcacatggtggtgcctcaggttgtagaacagcttgtctgtgaaggaaggtatgaaaagtgagacttgggtccaacttagaaggggcctcagactccaaactcagctatgtggatctgatcctgtgagcagaggtgctagggcaggaagtgatgatcatgagttggggtgcagggtggtggcggctcatacctttaattctagcacttgggaggcagaggcaggcaaatctctgagttggaggccaacctgatctacagagtgagcttcaggacagccagggctacacagagaaaccctgtctggaaaaaccaaaaagggaaaaggggaaaaaaaaaaaaaaaaaaaaatgaggagctgttgtgaccccctgggacacatcaggaagagtaagtatgttaagatcaggttatcattaagccttgcaatcaaatttgaatagaaagtccacccccaccccagcttactgctccatgtccctaaaactgatattgggaatcatctttccatttagtagttatcagtgcagatatgaggtatacccagtggcacacctagaaactcagtatcagggacaaatgatacagtgccatggagacaaacacttggtacacagtgtctctccacctaaagctccagagatgtctgaagtcctgatcatgcaagtcttagctcagttcagtagtacctccagtttgtccttggggacccacagacattcagcgcccccaagggtagttggtacttgagttctcattgggcttcatgggctcagtggttccaacagtctcatcagtggagatgaatggccagactctcacctgggcagcatacagagaggtgcaggaagtgcacatgctggccttgatctggctggtagtcggtacgtctcacacactcacactcaagttatgctaaaggttgtgtgtgacatgttagccataaacagtggtgtttatggagctaccacactgctgcatctcccttcctggggccttgtcacacacatcctcctgctagagcatgctgtcattccttattgcctgactaaccagctacttagctacatttccactgctttctatttcccacagtaagttgtatgaaggcaggaacttgtaagcagtgtttaacaaatacattaaacaggtggcttttgttgttgttttgagataaggtttctcgacatagccctggctgttctggaactagtgagtttccttggtctactagtgtagaccaagtttgccaagaattcagatgtccacctgcctctgcctcccaagtactgggatcaaaggcatatgcccccatgcctgaccccagtatggctttaatttcctccctttgcagatatccccctgttgggcattaggctggattcagtagagggtagagttaaggatgtctgggatgtggcatttaaatatatgtgtgtgcatgcagcaatggtggaggtcagagggcaccagaactggagcaacattatgagctgccatgtggatgctaggaactaagtgtaggtcctctacaagagcattaagtactcttaaccagttgctaagctggaaccagccctggaatgaaatcagcagtacatactacttagtgtacccagttttatgtggtcaatacagaaattctgggtttggagccagaactcagtgagcaggaacctcagaggcagtagagcaaaatgtctgaggattgcttcagggcagccccagtgtggatcaggcctcactgagtcttggaggggaggcttgtggtttcaccatgcagtatgagcagactggagagaaggaaggaaaaggttcacataaatggacttcttacagcttcccaggccatatcttagatatttgacatagttggacttattaacctcactatttgatgcagtgtgaaaaacctttactactatgtccctggctgtccagatggctgagccagtaaaggctcttgccaccaatcctgaccacctgagcttgagtcctggcatccacatggtataagatcaaccgcttttgaaagttcctgcaagaaccactcttctgacttctacctacacattacaacatgtgctcgcacacacactaaagtttaaaatgtaaaacactgcctcccacagggtacttagtgtggtattgtaatatttagaacttgatagcctagttttgttggttgtttttgctgttaagcttgttaattatgtatgcagtttcttcttatttgagacagccagttgtcatgggtttattagtaaaatggtagaccacttggcacccacgtagagtgtttctggggttaatttaggtgtcacctgagaaaacttattcatgacaaagctaaatactggcatacagacacagtcagatgcccagaaattaatggcaacttctgtatacctgtaaaacctgcagtctttgtcatcaagatcagggcttctggcctggagaggtacctcagcagttaagaatactggctgctcttccaaaggtcctgaattcaattcccagcaaccacatggtaggatacaaccatatatagtggaatctgatgccttcttctggcatggagttgtccatgccgatagagcattcatatacataaaataaataaatcttaaaaaaaaaaaaatcagaggctgggcattggttgtgcacgcctttattctcagcactcaagagacagaggcaggcagatctttgagttcgatgccagcctggtctacagagcgagtttcagaacaggctccaaaacaatacagagaaaccctgtctcaaaaaaccaaaccaaacaaaaatcagagctttcatggcctgagcccataggttcaaaccatgctgcatactgcttcaccctcatcagatctgaggcacctatgttaaactcagcaaaggttcattgaacctttgtctaaagtccataaatgaatttgggattgagggtatatctcagtgcacttgcctagcatttaacaagaccatggcttagtcctttagtaccacaaaataaactgatggaaaacatgatcaaaatctgagttttgccttgacagacagcactttgccctgtttttttttttttttttttgctaaatgaagcctgtcatctctatgggattgtatcactggaaaatgctttaaagaagcaaataactggccgagcgttggtggtgcacgcctttaatcccagcacttgggaggcaggcacaggcggatctctgtgagttcgagaccagcttggtctccaagagctagttccaggacagcctccaaagccacagagaaaccttgtctcaaacaaacaaacaaacaaacaaaaacaagcaaataacttcctgtgacctatcaaaatgttctgtttttcaggggctgggagcacatgttgtagaaggtagaaatcagccacaggccagggttatcaggatgaagtaaggcagtggttttcagccttcctaatgctacgaaccttttaatacagttcctcatgttgaggtgacgccaaccatgaaattatttcattgctacttcataaccctaattttgctactgttatgaattgtaaatatctgatatgcaaactacaaatggatcactacccactgaactaaggcgcccagcaatcacgttgaaatctcatttatactaatgtatgtgtgtgcacccacactcaagtgcagaagttagagtacaacccttaggagttggttgttgctatcatgtgtgtcctgggattcaatcctcaggttatcaggctatcttgcttatatcttcataatacaaatgaaagagcatgctgtaaagtgtccaactttacagctggtcctgcatgtggagactcattttctagcagccacttggcaggaggcaataaataaacttgtaggttaactcctgttcccagctgtggaaaataacctgctactgatgctcttctgaaagtctttttcctcctgccttgtatgctgttgtctttcttgtggtttatgtttctcgtggtttatgtttagtgatttgtttttctgttttttcctttttcagataaagactatttcctgattgtgattcagaatccaaccgaataagccactatctcagcttcctgtgtcattccttaatttaaggtcccccaagagtaatagtgttaatcatgtcagtgggcacatggtggttgcctaagagcccatgtagactatgccattgatcaagggtatctctgtccaccccaacaaggagtgtctctggtgatccagtcagttcctaggaaagctcagttcttatttccaggctttggagtaagagcttatgataagcccaggctttggagtaagagcttatgataagcccacacccagcttccttcagaccttgagttcactttgtcacccttggaaagcctgttttttctttaactaaaaataacttcaaaacctgctggctgtttgttgtgtctttactagattggaaaggtctgttcctatgtcagcacatgatcagctgaccaaacccatggcctctattccctggcaggttttcatggtcccttggcctggtcctcattgcacctgtggcatacttcctgaataatgcaccttggtatgtattggttggtgccctggttcctgggcctcattaccccttccttaggtacctgtttgatcaaatcctactcctgctaatgattttctgttgcactgccctgagcgaagaagaaagtgctgtctaccaagtacccacaatgcacctggtgcatcttaggtgctcacatcattgtgttaaaactgcctgagagctggggaattaagagtaatgaaaggaggaggaaacaggtactttccagggtctcatagctgggaacatgggtctgtaggtagcctgttctttgctcagtcttcctcagaaactgaccccgtctttccctggcaagctcgttcttggtagtcatccttccacctgtaccactatgtgcaaggtggtgggggtccttaccaggaggtctaccccaggctcttagactacccactctgctgcgcctcaccaccctgaaaaccacctgtatttgccattacacttttgttttcttttgcttgttgcatagaaaaaaagtcctaggttcaatccccagaattccataaatggcatgtatctagttagagttatgaaactctgcctttaaaaaaaaaaaagattcaggggctggagagatggctcagaggttaagagccctggctgcttttcccgaggtcctgagttcaattcccaacaaccacatggtggctcacaaccatctatagtgagatctgttgcgcttttctggtttgcaggcagaacactgtatacataataaataaatctttaaaaaaagattcagaattaataaaaagagactgaatttgaaagcaagcaaggagagttgtatgggagggtttggtaggaggaaagggtagggaaaacaatgtaattataacctcaaaaatataaaaggcttggggtagagagatggctcagttattcagagaaccttgtgctcttctagaggacctaaaaaatttcagttcccagcacccaaggagtacagttcacaaatcacacacacacacacacacacacacacacacacacacacacacacacacacacacacacacactgctcttctagaggacctaaaaaatttcagttcccagcacccaaggtgtacagttcacaaatcacaaatcacaaatcacaaatcacacacacacacacacacacacacacacacacacacacacacacacacacacggagagaggagaaagcaaaagttcaagagtttggagcctggcccaggagggtgagggatgaggcaggtagctcagttggtaaaagcacttgccacctgagtttgagttctggaaccgacatgttggaagagaaaaaccaatgcccgagctaaccacctcatagctgctatggcacacataccccacaaatacatttttatttttgcatgtatacatgtgtagatccaaggggtggggcctgacccagttgtctctgccctacctggctcaagtctgctgactgaaggaacaaacttaactgtcctgactccctcagatgggtatgatactgagggactcacaggatgctgcataagtccatcttgtgattaacaaaatcctgaaaatccttcaagacaacgatcatgcccctgaaaagtagtggttgtttacaatcatcttgagaggaacagaaaggataagtaagtatgcttagttaaggtttctattgctgtgaggagataccatgattatggcaactttaatgagatggcttatatttgcagaggtttagtccattttgtcatggtgcaacatggtggcatgcaggcagacatggtgctggaaaaggagctgagaattctacatcttgacttgcaacaggaagtagtctgtctcactaggtgtagcttaagcatagagacttcaaacctcacccacacagtgacacacttcttccaacaaggccatacctcctaataatgccactcaatttaggggccactttctttcaaatcaccatattgtactccctggtccccaaaggcttgtggccgtatcataatgcaaaaacacattcagtccaccttcaaaagtccccatagtctacaacagtcttagacttgtttcaaagtctcttctgagatccatggcaatctctcaactgtaatctccctgtaaaatcaaaatcaaaaagcagatcacatacttccagcatataatgatacaggatatatattactattccaaaacctagggaataccagaccaaagcaagacctaaaaccatctggacaaactccaaactctgtgtctctgtcttatgtcaaagccctcttttgacataagacagctttattgactgaaatacatttctctcttgggctggttcttttccttgttagcagctttctttgccagctatcccattactctggcatctccaatattttggcatatcccagacaaaccaggcttcaatgtcagtttcatgagatggcccctctgggcctccattcagggacactcctgacacatgcctggtctcagctgctttccttaatcatggaggcaaattccctttcttctatccttaactccagaaccacgtggccaaagctgccaagttctgtttgtcagggctataccatctttgcccccccccccccagttaaattacatcttcaccagttttccatggtttccttcactgcctaagcttggctgtcctagcacttgctctgtacaccagactgccctcaaactcaagagatcccccagcctctgcctcctgagtgagtgctgggattaaaggcatgtatctccctctctcctccccccctcacacacacacacacagagagagagagacagagtttggcgctacatagacaagcccaagcacatcaaatgcagttagattttgtttcccattgtctcaccgggtattccctccacatggcaagagcctatctgtgacctgctcatggagacagacactgtgagcctaccctttgtcaactgtgacacagcccaaagtgtctggccttcctgcccaccttcactttcccccaatgttgctaagaggctattgagctgggagaggcaagttcacccacactgctgtgcggtcacttctagtttgcctagcatctatctgctcccctctctgttgaccaaaactgcagccagatcacccctccctgattacaggtctcacagaataaagcctcctagaaccctcctgtcacacacacacagcccaggcaaaagtatgagaccacatggaccacttggctgtgctcctgtcccagcctacctggtctccttgcatgcaccccaggaactaggtgaagggtgacagaagacccaggcgtcttcctctggcctctgcaggtacatgtatgaatatagggacttcctgagttccatttctgaaatctaaggaaggagagaattgattccataaaactgtcctctgacccacacacactgtggaatgcatcatacatacaccacacaaagatttttaaaaaatacctgaagaaggcctgataaaggcacttgctgctaagactcatgacctgagttcaatacaaggaacccaaatggtggaaaggaaaagaaccaactcccacatggtgttctctgacttgcacatatgccctatggcacgtgtacacacttacacacacacacacacacacacacacacacacacacacacacacacagaatgaataaaatttgaaaagctgggtagcagtagcaacacctttattcccagcactcaggaggcacaggcaggcagaactctgtaagttcaaggccagtctcaactacacagcaagttcccaggggagccagaaactctgtctcaaagaaaagaaaaaaaaaaccccaccccccaaacaaacaaaaaacaactagccagccaagcatcatggcactgtcctttaacattcaagcacagcctgatctgcatcgtttcatggccctcagggctacatagggagagctatctccaaacaacaaaaacacaaatgacaagaaatgctgctttggatgcagggaaaacagactacttcttcactgctagtgagaatgtaaagtggtacacccaccatagaaatcagtatggggctttcctcaaaaaactagaaatagacctactatatgatatgatccagctataccacccctggtatatacccaaaggactcaatattctactatagagatagctgctcactgatgtttatttcttctctattcacaacaaacagccaagagaggaaaacaaacaaattagatgtccatcaactgatgaactgatgcaaatatggcatatttacacagcagagtatttagctattaagaaaaatgaaactataaaattcacaggtaaatggagagagatagaaacaatcattctgcgtatggtaactcagaaccaaaatgtcaaatgtcacatgtttttctctcatctgtggatgttagcttcagatatgtgtgtttcatttaaaacactcacaaatgttaagtattggactcccgattactgtgtatcctcccatgatgcaataagccaaaacaaatccaatgaataagaacagatttaatacacagagcaaagcacagcgatgcaactcccaggtgactctggaagacgggagagagatcacatggcaggtctggtgaccaggtcttaaacaccctgtatgtgtggtcttgagcagctccagcggaggagctgatccttgacaagctttctgaggggtggcgtctggaatgggaggatgggggctatgttccaaagctgaacatatgggcagggtttggaatgggggagagtgaggctggagtgaaggcagagcttccaccttgaaggtcaggaagttactaaggtgccatgttccagggagaggagataaactgcactggtatgaaggaatcatggaacaggaagggttaaactagggtgaggaagtggagggcagagcagaggacagagtagagcaagggataaataatactgaaaaccttttgaaaaagacataaagctctttctaaatctatccatcaccaccacacacacacacacacacacacacacacagacacacacacacactaaaatggagttactctgtaacagagcaacagtgctcctactagacatcagaggctaacaaaaagttcagtgccaggtatgagttgcctgttggtgttgttggtgggtacggccactgctcttggttaccctcctccaggcagtcagaaccttgctgaagacagcacatgcttgagtcatagaacatggcaaaaaccaagctggtttgaacctggaagctttatccctagtgaccagctagctttcataatctggaaagtcgctatgcaagtttttggagaggaaagttgttagtcatactcagctgtggacccttcaagctaaaaaaatgactgttaatagtagcacaaacatcttgggaagaaccaaccaccttttgattgaatctaaatccctgtctacaggatgaaactcatacctggcatcattatcaggctaagagcctctggctaaaaagtcaccagccatgggaaaaacccattactgttatgctgctaaatggacgtattattaaactgactcctaatgacttacattgtattcacagatcaatgtacatctcatcccttatctgagaagcttctaattgcaataaatagtgattaatacagagactcacaactagttatggtacagataagagactatagaatgttcagtcctaaagggatcacatataatgcaccctcctctctcaaggctaagggatcattgcagaagaggtggaggaaacagtgtaagacactgagacagtggatgactacaagaaaacatctttggacacaacagggcagctgcacacataaactctcagtagttgcaacagcatgtataaaacctgtgcaaatcctagcaagaagagaggagctgggcacacaattatcattccaggccacaaaactactggcaattgctagctactgggaaagggataggcaattttctctaagagtgcgccccctggtaaaggttatttaaccattcactgtagaagatcacatatccaagaacatttgacatcacaaaattggtcttggaggtgaaaaaaaattacacaaacttgggtaggtagaaagggagaaggtaagaaaaaaaaaaaaagaaacccatgaaactctcatagagaggctagagaaatggcttaactgatgttaagacgacttgaacttgaatagcagtgctcacatcagagggttcacaacctcctgtaactctagttccaggggaatccaactctgtcttctgggctctgtggtcactagacatgcacatggtgcacatacatacatgcaggccaaatgtttttataaataaaatctcagagaactaataaaaattctttaaatattgtatatgagtatgtgtgtgggggggtatgtgcctctgggttagtcagttcttcagttaaccatgtaggccctggaactcagatcagtcttgaaagcaagtgcctttacctccttgtaactttaaaatatttcatgtcatttaccctagtccaaaggctcacaacagtaatcccatctactgagaccagaggatctgaagttcaaggttttcccaggtttcagagttccagggcagccagggctacacagagaaaacctgtctcaaataaacaaagtcaaatttgttacttatacaataataagcttgatctcttgctcctccttgcctacaccttccaagtgataggattatggacatgagccattagcatattaaatttaaaaatcctagccaagcgatggtggcacacaaacctttgatccagcactggggaggcagaagcagatggatctctgtgagtacaaggtcagcctggtgttactgagcaagttccaagacagcctccaaagctacaaagaaacccctggtctggaaaaaacaaaaaacaaaaccaattttaaatcttagccaggcatttcttaagagagtaaatgtccctgtcccacaactcagcaattttgttcagcatttgtccaagtgaaataataaaacagccacacaacagttagaagaaatccacacaaaggaaattcatccagtctatgtgaagctggggaacaaacccagagtttcctgcaatcgaggcaagcactctaacaattgaactacatccccagcatgttgtatttccataggtgattgcaatgaatgtaaaatttctccagctctcactttgtgctatttacttttcaacataatctgcttctggcttccatgtttcattgtccttcactaatcccaccccctctttctttcttctgtatttgaaaccatattttacatttctataatcttggtttttttttttttttttttttggtttttcaagacagggtttctctgtgtagctttgaagcctatcctggcactcgctctggagaccaggctggcctcgaactcgcctgcctctgcctcccaagtgctgggattaaaggcaggcgccaccatttttattatcttaatgagccctcttgttttaattttttttttttacatttatttacgatgtgtatgtggaagtcagagatagcttgtaggtgctggtgttcttctcccaccacaaaggtcctgctttaaatattaaaaattctttccaggatcagtaaagagatgccctgagacagacttactattctgcctactcaccacagggaaaacaggaatgtgaaatactttctgtaggaggaatgtcttgtagtagtgaaggtactaaataggacttaaggccataattcaggaaacctactgtcctaccctaatttgtgggggctacatactagcttagcatttgagggatataaggcctggctgatgtctgcaggggcagcctctttgatctaaccttggaattgaactcaggtcctcgtgcttgagggcaaacactcttgtctacagtgccatatagctgccttccttttactgtttgaaatatgtacctgaacaagcagacaataatatacttctttaagattttatttatttatcatgtatacaacattctgcttccatgtatatctgcacaccagcagagggcatcagatctcataacagatggttgtgagccaccatgtggttgctgggaattgaactcaggacctctggaagagcagtcggtgctcttaacctctgagccatctctccagcccaataatatacttttaaacatatccagcttcctaggacatacaaaaaaacaaaacaaaacaaagccgggcagtggtggcacaagccttaattccaggagacagaggctgaggcagaggcaggggaatctctgtgtttgaggccagcctggtctacaaagtatgttcaggacagctagggctgttacacagagagaccaattttgaaagttctttaggagctgcctctccgtgtccatgctccccacttcccataaagcctgggaaaatgaatttaagccttcctcgaggtaggaaagtactgttccctgcgtaacattcctagactatacttctttctagcttctcaaagggctctacgtgtgaattctcagttcgtgtgttgtcaattccgcatgttctctattgcctggtaagctgcttctgatacatcctcccattccgtgatttttctctcctactttatctacatcgcctattaaccccacatcgggagactatgctttttacggctgatgcagaaactttttaaagcccggcggggtgggagtggggagctggagcgttagttagctccacagttaagagcactcgctactattacagaggagctcggttcggttcccagcaccgccagtaactcactccagcctccggaaatccgactttgacctcctcgggcacccgcactcgcgtcgtacacagacacgtaaaacttttaaaagccggggcgttccactccctccccgcccggtagtaacccgcccgtcctccgttactacctttgatctctaagttcagtgaaggggcagtgtcaagcgctggaggggacgaccaaccggctttcccctcagtctgaggagccaagagacaagccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggcctcacgccgagtgctgtccgcagctgaccgctgtaaggaggtgcagcagatccgcgaccagcaccccagcaagatcccggtgagtctctagcccccccggccctggcctgtcctgccaggccccgcccctggctcacgagtcccccgcccactatgctcccaggtgatcatcgagcgctacaagggtgagaagcagctgcctgtcctggataagaccaagtttctggtcccagaccatgttaacatgagcgagttggtcaagatcatccggtgcgtgggcagcctcctgaagcccttgggtggggtcagggccaggttccactcggaaggggtggagtggggcaaggggacaggatatagggcatccagcccctgttctaggaggctggacaaggtcaaggtcggggttggagtgaacttctacaaaggtgagagcgtctagcccgggctgtgttggttcaaaagtggagattcgggagggacacccaggcccccagcaggcgacctcctcacctggcatgccctcctgcctctgcaggcgccgcctgcagctcaaccccacgcaggccttcttcctgctggtgaaccagcacagcatggtgagcgtatccacgcccatcgctgacatctacgaacaggagaaggatgaagacggattcctctacatggtctatgcctcccaagaaacctttggcttctgagtcaggaggaggggtgggggatggttggggattctggtcaagctttctccagggaggtcctggctcctaagctgagctatttcattcccgagtgggttaggcagagatgtgaactccctacccctcccctggtgggggacaccagccagcctaccatgctctggtgtaggtcctgccagtcacgttagggttgctcctctgggtactggctcagttgggagtgggtggggaacagcacccctgctgtgtggtttgtcttttttttttttttttttttttcagcccttgcctgtctgcccacctgtcccttatccacctgaggcatttgcctcctgccaggacctgcccatctctgaaaggctgaccccgttgtcctgacatggtgtatggatctgtggtcatttcctcagcaaaataaagattgcttaggcctgcctggccctttgcctccagctgcttgtttgggagtagggagggctgctaggtgaccgtctccacatacttgtgccagtcaggacacaggcttgtgttctatggacttgggtttccaaaaacctacttcttagtacaggatactctgcagtattaggggccagattcaccccactccaggaatagatggcatcagaacaacaatgaaaaaacccacacatttattaagtagccacaacctataaagccctgctcacctgcaggtttccccttccttcctgtgcagtcacaaagtgggaggtccaagtggggtgctccaaacttctccccctgggccagctatgagtcccctatggtaccagagatttgtaaccctggatttgaacctcttctgcctgaggactcgcctgctggcaactctggataagggacctggcgggctcctggcccttccccctcttgtccatgcagttctgtgccagccagggctacttgagcacaagcatagcctctgtgccgtccttggcagtcaaatagagaccatgtgtgaggtaatactcccgtcgcaggaaggcatagaagtagtcagagatgagcaggatctggcagggaagagaaaatgagaagccatggggtaccttagtgaataagtccctttgtggggttagacaggtactatgaaatagttcctgcctggcatctctcatcaaaccccaatctataagcctgcccagggatctccttccctcttggcacaaacctagccctgaaagagctcactggccatctgacagctgcctgtattttactttctgcttcctactcctggtttacacctctatcctagggaatccagatcagtgttctaccaaacagtgcatgcaccttgtctcttcccacaggcatcccccatccagcctcccttgtcaaacatcccctgtccaggggttcaggacacagacttgcctagtatttctcccatacgtacatcccagaaatctactttgaaaatatacaattccacccatccctgtaacaacccccaccaaagtcactgttgtcatttaaacattaccaaaacagcttcccagggatccctgctttgaaacctcctgtgccagtcagccagagggagcttttcttttttattttttatttttttgttttgttttgttttgtttgggttttggtttttcgagacagggattctctgtgtagcgagagcctatcctggcactcgctctggagactaggttgcccttgagatccgcctgcctctgcctcccgagtgctgggattaaaggtgtgcgccaccaacgcagagggagcttttcagaccacaaatctgatcatgctactacttgacttgagttttcccaaaggcttctcatgcttcagactcttggagcttcgtggccttgcacctggtccctgctacatgttacatcacttccatgtgctacctctctaaccacaggtctttgctgtttcctctgcctggaacatttgcatctgtcgatacctacttgctcttcaactcggttgcaggctgactttcccctgggttaggtcctaatcccttaacctctctgctgacataaagtccttcaaactgcaactttacatccaactacgtgacacttgatggtaacgctgcttctgctaaggatggaccctgagtgcttctgccacagtggcacttatctgccacagctcagtctgaccaaaaaaaccaaaaggggccgagaattccagttcattctcaccctaaatggagcctgagagagggacaggatttgtctcacttgaacacttgaccccaaagtctacaactctagcccaacatgcccaagactggaataactggaactgacatggaagtgccccacctcatcaaaggaaggcaggcacactattagagacaccacagttctcaaaagtttagaggttctcagtaccagcagcaattatctcttagctcaaatgggagacaggcctagaatgtggcaggcattcagtgagagtcttggggcagatcagaggttaaatccggggtccaagtctccagagccctgtcctgggcagatatacatttttctgaaggtagaaaagcagctaagaagatcttggagggccaaaagcattgatattcaattggacatacacctgccattatctcattggaaggctaatgatctattttaccaatagaaaaattgaagcttgaggcattcaattagttggaccaaggccataactggagatctggactactgggcatgcgtcctcaagtatgtgatgtgccatgggccctgtccataaaagaacacagcccttggccagcctggtcgtatcagcagttattgagcttggagcccaggggttttcccaccagacccttaaatgttctgtctgggaaagggaaacccagtccctgtgccagagtaggtgagaggcaattgcaaatccagaattcacatgtccccacagtgatgagctggctaggtcaagggaaggcagatcaaactaagttattaggttgagccacatctggaaataacatttttgtttgttttgcaagtcagtaatgttggcaacacctgggtggtggtggctcacaccttcaatcccagtgctcgggaggcagaagcagtcagatatttttcaaggccagcctggtctacaaagcaagttccagtacatccaccagggctacactgagaaaccctgtctcagccagtaatataatgttggcaattttacaggatccaattaatgtatatgggaagaaatatacaaatattaaacattattcagaagaacctgacctgaagaaataactataggactctaagaggagctgtacattttttgttgttcagtctctgttggaaataggatctgcagagcccagggtagctaaaacttggtacatggcagaggatgaccttgaaggcaatcctcttgctcctacctctcaagtgcctggattacagaggggcacctcctaccacaggaggagctcaagagctattcctataaaccttaattctgtgcaccaaattcatgtattacttggattaaaaataaaaattcagggctggagagatggctcagaggttaagagcagtagctgttcttcctgaggtcctgagttcaattcccaacaaccacatgggggctcacaaccatccgttatgagatctggtgccctcttctggtgtgcagatatacatggaagcacaatgttgtatacataatgaataaaatttttaaaaaataaataaataaaaattcaggccaggctggtagtacatatttgtaatcccagcattggaaggggaggctggagaattaggtttttgtttttgttttttttttctctccgagacagggtttctctgtgggttttagagactgtcctggaactctctttgaagaccaggctggcctcgaactcacagagactcacctgcctctgaggctggaggattaataaaagtttttttgttttactttgtttttcaaaacagggtctctgtgtagccctgcctgacctggaactctctcttttatgtagtctaggctggcctcaaattcacaagagataaccctgcctctgagtggggattaaaggcattacacctggctgactactgcatgttccaggtcagcgtgcgatagagtgagactgtgtttcaaaacaaaccccaaactaaatgtgacatacatttagcatcagcttgaaatcacatggctggcacattctgaccggataatgaaaacagggcttgtcctagagattctttctcttttttatagtttttaaaatttttcctttatgtttattttaccctacatttttgcctgcatgcacgtatgtgcaccatatgtgtgtctattgggattgttgaagattgtgagtcactatgaagcatactaggagttaagctcaggttgtctacaagagcagcaagtgttcttaactgctgaaccatctctccagcccctggggattctttaaaaacaaagaaaaagaacaagtctcagtctaatgacaagcatcagaccaacctaatttaggggacctgcccaatatcccttaagcctgtcaaggtcatgaaaaataaagacaagggatacagagcagaggacactagggagacacaaccaagtggtccactaggttggtcctggaagaaggcgtgactcccattcagttaatggtaatgtcctagggagggttcttactttaatagaggtcctgtgtaagatattcacaacacaggaaaacaatgaaaaatacaggacttctctctactatctctgcaaccttctatggttccaagttaattccacaataaaaggtttatctagagaaaccaaaacaaacaaaaatgtgctttttttttgttagggttttgcttgtttaggggttttgttgttcttgtttgttttgagacagggtctctgtatgtagccctagttgtcctggaactctctatgtagactaggctggcctcaaatcacagagatcttccagcctctgtctcctgactggtggttactaaaggtgtgcatcattccatctaacttgttttgttttgagacaggatctcttgaaacccatgctggccttgaactatgtagcagagagtccccttgaatttctgaatccacttctacgtcccatatgctgaggtcacaagtatgtgccactatatggttttatgtggcaagagggattgaatccagggctttttacatgctaagcaagaactctttaagagctatcttcccaccaggtaggtaatggtggtacacgcctttaattccagcactggaggcaaagggggggggggggtctgtgagtttaaggccagcctgggttacagaaaaagttcaagacagccaagactgctacacagagaaaccctgtctcaaaaaaaaaaaaaaaaaaaggaaagaaagaaaaagaaaacaatcagataagaagcggcagcagcaatattctcagtctgtttgtttctttgagatagggtctcaatatctagcccaggctggtttggaatttactatgtagccagctagaagaaggtagaagcaggaagatggagttcaaggtaatccttggtatcttagtaaagtttagaccagcctggtccacgtggattgttgtgagaacacaatgaacctcagaaacattggtgggcaagacacagtgaagaatactataattacagccctcaggaggcagaagcagaggcagagggatccttttaagttcaaggccagcctaggctaggctacccagggatacgtaaccttgatttcaaaccaaaaatggtaaaaggtagctttgacaaatacacatgtaagacccaaattttcaactatgttacctttgtgtcagtgaagtggaaataaactattcaataatgtaaaagctgacatctttctttctttctttcatttatttttttgatttttcgagatagggtttctctgtgtagctttggagcctatcctggcactcgctctggagaccaggctggcctcgaactcacagagatccgcctgcctctgcctctgcctcccgagtgctgggattaaaggcgtgagccaccaatgctgggcaaaagctgacatctttagcagaaaatgtactgatgtctgcatttcaacttgaaataaatgtaaaaataatccagggcgggctagtgagatggctgaggaggttaagcatccgctgccaagcctgatgacttgagtgacccccagaccccacgtgatggaaggagagaagtgactcctgaaagttgtcctctgacaacatgcaagctgggacatatgcatgatccacatccacaaacacaaaataatgtaaaataaaacaaacaaacaaaacaaccagggcctgttgctgaagcacctaggagatatccaggctgcatgagacactgatcaaaaaaaaaaaaaaaatagtaagtaaaaagccccaaataacagtaaaagaaaagatggcttacgggatgtattttgtaaccaagctagtacttcggaatgttactgatagggtttttgtagtgggtgaagtgaaataaatatgtgtcagtatttgcataacaaagtgtagaaaagggccatgctcatttggacacatagtgtttaatgtcctcacttatgagcaggtgccatgactacagggaaaggatagaaggctagctggagcttggccctttcagaggaaagcctgggcctgggactttccattaagactgcaagaagaagggatttcccagaggtcccaggattcaccctgctcaacagctgcaaacccacaggccctttgcctattctgagcaggggaaagttgagcaggaggtaacaaaagcatggataaattagtaactgacttcccattccttaaatttctttttccttatgtagaaatccagagccatcagctccagtttattatctgccatagtgatcttcactagtgcatacttagggttttggggcccaagaacgtgtctgtctctgccttcagagacctgtggcctgtttttggaagctgccctgcttgctgtcgctaatctcccagctctccctggcttgtatttccacactccccttagggttccttttatcccccaacacagccattttattgttgttgggttgtttttgtttggggacaaggtctccctatgtggctctggcttagaactcactaggtgaccagtttaccttaaattcacaaagaaccacctgcttctgcctccaagtgctaggattataggagagcaccaccacactgggcacctccacaggaacttattagaggggtgcagggctcagggagggggtggctcccttatctaacttcttggccccagaaggatctctttttgttgctttttcattttgagatggtctcactttatttatagcacaggctgcctggacctcaattatgtagaccagactggcttgaactcagtgtggtctactgcttcaagcacctggatgcccagactgcatgcagaagcctctgagctacggtgcctgcacacactgacagaagcctcgctctcccctgcccccataacaaccccatgctcagttatatgatcccaatgggatggcatctgctccaactctggagcctcagacctggcacagagctcattttccgagtgcatgtgttggtccttaggctcttggcactacccttcaggcatgacttgtgagacttcactcctttccttggcaatcataaaggcctcagggctgctcttctctgctctgtggtagacacttcataagttaatcagggtcacagtggacagaataaatcaaaaatgaaatgagacctaacatgcttcagagccaatgtgacagaagagagacaaagaagaacatcttctaagcacctggtcaggcctttaggaacttcacaactcccgggctggggcccatttataaaccaggatcacaccggtatgagaggctatatcatcagctctacctgtttacatccaaaaatcttcccaccacctacacttcttaggcttggcactggccaaggctagttgatcttccatgccctaacaagcacccgggggggggggggggggttgtgttccccacattacagctctgccactccaccagattctccttggaaaaggcaaagtaagtttgagacttcagagccaactggtcttgaccaatcagagcctcttgactccagcctccaggagacagatgtggtctccacccctaggcctcttccttctgttagagacaccgacactctcggggacttcaactggttgccatagttggcaaagtgctgcttccttggccacctgcctggagtctaggcaagtagaagccagaggaggctggcagctgactgtggagctctgacctacccactcaggccaaacagactctgcaagggaggagacagtaaacagtgcttcaccttccaactctaaagattcaaagcagcagggaaagggaaagtgatgtcactaacagacctgcaatccctgcacttgagagttggaaggaggatcagaaattcaagccattctcaagcactaagtacatttgaggccagcaggagctaccagaaagagatgctgtctcaaacaaacaaacaaacaaacaaacacaaagaaaaagtcaggaaaatcacaggacttcaagacagtgtcaccatgtaggactgtagactggtgccagagtagcaattgttatttacctggccctttcaattgtcaaaagcattcttgttcaacatcatactgaatccatggccaccttccaagtaaagaaaccaagagtacagcctctcaccagattacagcagccaccttctccacaccagggttccagctcgcaacctcttctcttcctggcagcatacagtgcacagtctaaatccaatcacatttatccttggttgaaaactaatggttcagcctgaacctcagcataatgaggtccccaagggctgtgtagtctaaccactgcaaccctggaatgttctcattcttcctcaggaagcacagtcagtactacacaaccactaatagcacacagaattacactctttcttgggtttccccttctctctttctccttctccctcctagtacccagctgaattctgtatgttcccccgcactgtatctagaaaccactttctccaagaagcattcacagtcctggctcccagccccacagtgaccccatcaccctgcttgccctgcttgtttattttgcattctctcccagactgtgggttccctgaaaggaaggctatgtctcattcatctaaagagctgtagagagcagtagttatgtatgtggagtatgatgagaactctctttcaggatttaaacaaataggaagctgcctcatatataagcaaaggaagattaccaagatgttttcttaaaagaaagtagaagattctctctctctctctctctctctctctctctctctctcttacttgtaaacttgtacatgatgcttgtaaacacatggagagtgcctcagaaagccaacctccaagcacacgatccagattacagggggtctccaatttgtaaaccttccttaagcattagccacatttatttataattgtaagtaagattccctgtgttctctgttcttacatttatttagggtgactgggatacttttcttttagaaaagacagattcgtgaagtgtgtgtgtgtgtgtgtgtgtgtgtgtgtgtgtgtgtgtgtgtgtgtgtacataaatcactgatagatttgttacacctataatcccagaatttgagaggtagaggcaggaagacaaggagttcaaggccagcttcagctacatagaaagctagaggtatggctgggtacatgagaccctgtccaaaaatttatataggaaagaaaaaaagagactgtctcttccttataatttatgaactgaatactgctccagaagtttgctgtgtatatcaacagagctcactattcacatttcacctgccagcatgtgactgatggcaaaaataagacccaggttatatcaaatcctttaaataccctatgaagtggaaattatcaccctgaaatctgagactagaaacaggaacctaaagaagttaaatcacctgctacaagtcactgtgagagagttggaggagacctcaagcaatcaaccagtagattccaatcttatctctcacattcaatcacatacacacaaaaacacacatgcctcattagatggtttactactgttatttcctgttactgactctgaggcaatggtaattaccaaatgatgtgtacttaccacatgatgaaaaatacctaatggtccccaagagagagaaccgagccttagtcactggagtacatgctgggataactaatagtctacacatattcattctgtaataggacgagatacttttcaatatgaacagagcaggactttaacaaaactcagtaagtcaagttgttctatgtagtctatatagataaaactgattttgacaatgaaggtctgggttctggtcacccatctggaatttgtggccatttggcacacagaaaagctcttatctgcctgtaccagggagagaaggaggaggctagaggaaaatacctttccctgctagaaaggtatttataaaaacaggctgtggaatgagcatatgttcccaaatgcctgatatcttaatagaaatgccagcacacaagaaggactaggcttggctgtgcaggacatgaagaggccagatttggatggaaggaaaggatggagacagtgctaactgacctcagtcagatgtgtgacttcacctccatctttgcttccccccccaccttcacatcctcttcctgtcctcctcacctcttccctccctgaggcgtatcttaccacttaaaatctactctaaaagcactgctatactcatatgaaccatgtgaaaaaataaaaaaggactctttcattataagtaccaaattaaccagaagcaccctcaaatcccaacagcaaaggattacctggtcaaacaaatcacagtgcctcccacccaaggaacatgatggggccactacaaacattcatctcaagaggctgaggatggagcccagtgggcagagtgcttgtttagtatgcatgaaacctcagttcagtcctcagcatgacataaaaatcggcacatgcctgtaattctgacattcaagaggtagatcaagaaggtagtttaaggtcatcttcaagcacatagagagtttgaagccagtcttggctacatgaaagcctgttagattggtttgtttttaaagatttatttatttattatgtatactatgttctgtctgcatgtatgcctgcacaccagaagagggcaccacatcccattacagatggttgtgagccaccatgtggttgctgggaattgaactcacaacctctggaagaacagccatccttgattgttttgctttgttcatttaaattagaaacaaactccttttacatgctaatctcagttccctcttcctcccctcctcccctgccccaactgacaccctatcccaactcatttcggctccccagggagggtgaggccttccatgggggatcttcaaagtctgtcatatcatttggagcagggcctagaccctccccagtgtatgtatctctctatgtggaatgggctcccaaagttcatttgcacactaggggtaaatagtgatccaccaccagtgaccccatagattgtccagtcctccaaactgacctccttgttcagggggtctggaacagtcctatgctggtttcccagctatcagtctggggtccatgagcaaccccttgttcaggtcagctgtttctgtgggtttctccagcctggtacttgattggttttttgtttttgttttgttttgtttttcgagatagggtttctctgaattattttggagcctgtcctggaactctgtagaccaggctggccttaactcacagagatccgcctgcctctgcctcccgagtactgggattaaaggcatgtgccaccaacgcccagcccttgattggtttttttaagttacttttattattttatgtgtatgggcatctgggtattttgcctatatgtatggtgtctgcataagtcagacaagggcatcatatcccctggaactggagttagagacaattctgggtgctggtaatcaaaccctagtcttttgtaagagcaaccagtgcttttaactgctgagctgagccatctcccctatactctgcttgtttggattttgttggttgtttggctttatttgtttgtttgtttgagacagggtgtctctgtgccctggctggactagaactggctttgtagaccatgttggcctcaaaaattagagatctgcctgcctctgtctcccaagtgcatgctctaccaccaccaagcaggattcttttcttttttccttttttctttctttctttttttttttttttttttttttttttttttttttttttggttgttgttgtcttttgagatagtatttctctatgtctgtatgtaataactttggctgtcctggaactggctttgtagagtaggctaggctggcttcaaatttacagagatccacctgcctctgcctcctgagtgctgggattaaaggcattcactaccacacccaagttttgttgttgttgtttgttttgagacagagtcttactgtgtagctttacctgtcctggaacttatagaccaggctagctttgaacgcacagagatttatctatctccgcctcgaaagtgctgggattaaaggtgtatgccaacacacctagtaagactcagtttgaaaaaaaaaattgttttaattttatctcaaggtgagtatctcaaggtgaaagcaccaagtctgagagcagtttgtagattaggatgtttttgactcaaacacacaaatgtccttatgtacatgtcctcatagccacctgttaatgtatcagcctaaaagacacaaaccagactaaacagaggaccaaatgaccattgctagtgctggagcacacccaggggtcttaagaatgctagataaactatctgtggtggtgcatgttgttaatcccagaatttgagaggcagaggctggaggatctctttgagtttgaggccagctgttccaggacagccagaggtacacagagaaatcctatcttgagataccaaaaaaaagaaaggaaggaaggaaggaaggaaggaaggaaggaaggaaatgctagataaagatgggtatggtggcacgcacctgtaatcctagcatttgggaggctaaggcagaaggatctccaagagctggaggctaccacaggctgtattatacagtaatgcaagccagcctaagaaggggacacacactgtctccaaaaaagggtagaggatagctcaattggtaaagtgcaagcataagaacctgagttcaatccctagtaactatattaaaaaaccatgtggagcaactctaatcacagtactgggagggcaaagacaggatccctagagcttgttgggtagcccgtctggctgaactggcaagtgccagccaggttcacggagagacaatgtctcagaaaataaagtgaacgggaactgaagaagacacccagcatcaatttctggtctccccacccacaagcatacatatacacactctccctgcataaaagcaaagattactaggccaatactatacactgagtacattctcagatcctactagagacttctatttgttgtttgttcttgtttctgtttgttttgagatggctttaccaggccaggaaagccttgaactacacaggcaaggctggcattgaattcctgcttccacctcctcagggctgtaaattaaagccgtgtgctaccacacccaccctcagatctcctcactggggatttaacctagggcttgaagcatgctaattaagcatatgactgctaagctacagtcctaatattggaactttacttttcattcaacattctttcacttcttttccatgacaacaataaattcatttattgcttatgtgattaaaatgtattcaaaatgtttttaaagggtaagaaatgggagctacaaagatagcccttcagttaaaagcactggctactctttcaggactcagtttcaattcagcactctcatggtagattataacatctataactccaattaaaagtctatacccttttttcacctccataagtaccaggaacacacatagtatacacacatagtatacacacaggaaggcaaaacactcaaacacataaaataaaaagaaaaaaataagagatatgaaatgatggcgctggggagatacctcaaccaataaagtacttcacatgcaagcatgaaaacataagtttgatttccagcatccacataaaaagctagacatggctgggcagtgtggcacatgcctttaatcccagcactcgggaagcagaggcaggcggatctctgtgagttcgagaccagcctggtctacaagagctagttccaggacagcctccaaaagccacagagaaaccctgtctgggaaaaaaaaaaaaaaaaaaaaaaaaaagcagctagacagagctggagagacagaggatccatgggactggccagcttaggctaaattggcaagcccaagtgctagtgagagacctttctcaaaacacaaggttggtgggagggctgcagaaatggctcaggagttaagagtgctttgtactctttcagagaccaaagtttgggtcccaggagacacacttggtggctcactaccacctgtaactacagctccaagaaatctgatgctctgttctgacctcctaaagcaagcatgcacacaaacagtaataataaaagaatttaaaaagaaaaaaacacaacaacattttgtttgtttttgtttttggagacagggtttctccgtaggtttggagactgtcctggaactctctttgaagaccaggctggcctcgaactcacagatctccacctgcctctacctcctgagtgctgggattaaaggcgtgcaccacctgcaccaccaccaccaccaccaccaccacccagcaaaaaacaaaacaaaaaacaaaaaacaaaacaaaaaaaaaaacccaacttttaaaggtaagaaatgatgccaagaacttggctattctctgtagttcaactaccaatatactggatcctactgcctttgatctgtagttcaacccagcccctcttttccaataattaagtttctcttgcttttgatggcacctgatgagttgcacacagccccctggtattaagagaccttcctttcatacaggcagcatcccacagatgcctcataaacattgccaatttcattaactgagcaaaattagagtcaagacaacaggctgagggctatttctttggagtttgccaacctccgtataggccaaggtaggtccaagaccatcacatccaagtcctgggatacatgcaaaagaaagggactctgaaaacagaagtgccaggatggctgggatacatgcaaaagaaaggggctctggtaagcagaagtgccaggatgaccttttggcttattttagacactacagtgaatcctgtagatttctgcccttgtaggacatactcattcaccgtcagaaactgccactagggctgtttcatgctagaaacagccttttgctgttcatataccaaaggtggatgggttggatgaaaatcctccagtaacattcacacaagaaacaccagtcccaccagttcactagcaaaagcttaaacttctccccaaacttctaaccctggagacaagaagctcctgggcctattctctgacaccattagtcttttcaaacagctccacttctaagccatccactattcagggaaatgcctggctaccaagggcattaaagtgaccaacagtataaatgatctttcaagacctcaacaatgagggcagtctgccatgaaagaacatggcagattgaacgagagaacttcaggaaagatggatgattccacaaagggctttccagacctctaagagagctagctaaaagtataaacctcaaactttgtttttcatgttgaaccaagatctttaggaatgagccttagaaatctgtttaaggggggctggagagatggctcagaggttaagagcactggctgctcttccagaggtcctgagttcaattcccagcaactacatggtggctcacaaccatctataataaagtctggcaccctttctagcatgaaagtgtacatgcaagcagaatattatatatatgataaataaataaaatatgttaaaaaaaaaagaaatccgtttaagaataaaacaataggggcttggggctggagagaaggctcagtggcaaagaaccctggctgctcttcctggacctggttcagttcccagtatctacatgatggctcacaactgtctgtgactccagttctaggggatagtagaaactcaggaggttggtcagaaggatcagaagatcaaggtcattgttggctacatagtaactttgaagccagactgggctatgtaagacagctaccgttcacccaacagtccatccatggcattcccaaactccctgcctttgcttctactgtcctcaaaacccacctttgacccactcagcatacttcatttgatagtgccaacaaggctcaattttacaagtacactgcttttcaagttgggcctgactgaatttgtttcttgactccactgaccatgagtgaagagcctcagtaaactatttgtaaactatggatagcactttctctagatttgttgtaaggattcaatgaagcaacactcagcatggcactcaacacatgatcagtgttgggaggtagaagcaggggcatcaggggctcaaagttatcaacaaaagattcagttttacacaattcactcccctatccctttctcccaagtgagctcaatgacagatgagctctccccgctgcataattcaaaactagaggatgggaaccagggtctcaaccgacagcccgaggctcaaaatgaacccctgaccctgtgctaccctcaactctcacctgcccaacgttgaaggtcagtgtgatggcgtaaaagaaattggagttggcacttcctgcataaatccagagatgccacaggacagggaagagaagagagcagacgacgatgatgcaggtgagtacgaaaacgttccgtaggactgaaaaacagatggtcagttagtcccgcactcttcctctggccccctctttttgctgtggtagcctcacaggacagggagcaggtcatatggctcaaaggcagagcactcctacaaatattgtgttgggaggcaaacctcagaccctggtcaatggctccccatgcccataactgctgggaatctacatttggagactttcctcatcacttccacagccatgatgtctcatggatgagaatgggacctgaaccggcatgatgagagttccacagtgggggtctgcatgatgccatgcccacacagggtaaaaatgcactgtctcacgtgcttgtattgctctttaaatgaccctcttcactcttccacagacaacttacaaatctatctccctttccatcctcccagaccaagatctcctatagcacagcctggcctcaaactaagtaaagataactttgagcccctgatgcccctgcttctacctcccaaatgttgggtgcaggccataacaggccatattttaaaattatatatacgatcattttgtttgcatacaggtctgtgtaccatgtgtgtgcctggtgcccaggaaagtcaacagacagttcaattccctggaactggggttatgaacagttgtgatttgccatgtgggtgctgtaaactgaacaagtgctcttaagcacagagtcatctctccagcccacaacccccttttcaatgcccttctttcttacattacaccttgctccagaaggaaggctgagaccctataggggggagcactataccagagcttggacaggcaggcagagtttagtttagattagggcacagatggtggccacacaaagagttgactttaagggagagatgagtgaatatcctactctggcaagcaaagtgtgatggcccatgcctataattccagtacacaggaagttggggacaggggaaagaggagttgtttgaggacagctttggttacaaaccctatgtcaaaacaaaacaaaaaacaaaatcaccaccacaaaaattcatcagtctttaggttctgtaagtcttagctacctcatctctaaaatggggctaaaatgcctgttatgtgaatcacatgagactttgtgcaaaagtcagatttgttgacaaatacctggtcttacagcaccggagggagaatggctacataagtaagaaacttataaccgtctcaaaacacaaatcaccaacagcaaaagggtatgaaaaaaaaacaaaactggacattgtatttattactatgtgagttttctattgctatagccaatttccataacagcattttaaaaaatataatttaccactacccatttcttaggtcagaagtccaaaatgggtcttctgggccacactcaaggtctgggcagaactgtgttccttctggattctcttggggagaatctacatgcttgccttttccagcttgttggggcctggagtctttagctcataatccccttacagcttctggcactgggagacccaatccatcttagaggttaccattcttgcctcttccatgccttggttatccgctgttctgtttagaagactttgttagatttgttagagcagttttaagttcacagatagctgagttggagatacagttttcatactctccggcctccacctttcttctttgagatatccttatacttatactgcacctgcaatcattactgtagagtcccttttgctataaaagggaacaaattcactggttctgaaattagtgatatggacattgttgggagtgatgaggaagggaattattctgctgaccacaggtactcagtttgttttcttttgatagtcatctctgacagtagaagatgtcactgttaattctctttctactttattgtattttaatgtacatattttaaattaagtaatttaaacaacataagatataatcatctgcactgggcctggtccccagcaggaactcagtgaagtgttgttcctactacttctctgatgcagactcacaggaaaccagttttctttccttttctttttttaggataaggtcttacattgtagccctgaatagcctgtctctgactgggattgaaccagagatcagcctgcctctgcctttcaagtgctgggattaatggtgtgtaccatcatgcccagaaaattggagatttacaaaatgaggcactcacggtcactctcagttctaccatcactggactgatacactggaaggggactggataacagataattctctgttctagctgcaaataacaggggagtcccactagagtctagggtacagcctacacagaggttttgtaagtttcctgggtaactgaatatggactctgacagtctgccatagaatcaccactaatgtgtggactaatagaacaaagtagtttgaggttatttttacataattttttaaggtttatttatttattatgtatatagtgttctgcctgcatgtattcctgcataccagaagagggtgccagatctcattacagatggttgtgagccaccatgtggttgctgggaattgaactcaggacctttcgaagagcaaacagtgctcttaacctctgagccatctcttagccccactgaggttattattggtttttttttttttaatttttcgagacaggatttctttgtgtagccctagctgttctggaactatctcttgtagaccaggctggccttgaaatcacagagatccacctgactctgcctctgtagtgctgggactaaaggtgtctgccgcggtcgccgccgccaccgccactaccacctggctcactgaggttatttttaaagctgtgttggcaacatatagttcactaattttgtttggctgattttgttttttgaagcagggactcataaagttcaggctagccttacttgatatgtagcctaggatagcatggccttaaaactcctaatcctcctgcctccaccttccaaatatcatgcccagctacagttcattctttgtaaagaaggataagaatccttcttttgttattatcatttaaaaagccactttagccgggtgtggcaatgcacccttttagccccagcactcaggaagcagaggcaggcagaactctgagagtttgaggccagcctggtctacacagtgagttccaggacagccagagctacacagaagaacccagtctcaaaacaacacaagtcatttaaaatggggacaatattggtagctgtttcatccaccaccaaaataaaaagctttaaaaaaatttctttctttttttaaaaaattttatttatttattatgtatacaaccttctgcttccatgtgtatctgcacactagaagagggcaccagctctcataacggattgttgtgagccaccatgtggttgctgagaattgaactcaggacctctggaaaagcagtcagtgctcttaacctctgagccatctctccagcccaaaaaacatttttcaaatgttagtggtgtaggaaatcccttaatttggacactagcctggaggcctgaaaggaatcagaaaaggttgccttttctgatctgatatttccattgtcctggacggtcaacactgaagggccaaagtcctggttcagctctcctgagacctgccagggagcctgggcctcttgctctctctcagggtagggagcccaggaaaagctatgtttacactgttatcacattgttatcatcaagcagcattccaaactgaagaaaggagaacagagctgcttactcccccactgtatttcagttctcagtggttctttctcatcctctataaatatcttggctgaaaagaacatgtattattactagaataaaactttgcagggcctggtagcccaagtggctcctggttctgtgactcaggcagagacagaggctctaaagggtgaaaggaaagagactgagtacaaaatgaaagaggctacgaatgtagcctctgggctgcaaagagacttcaatgtgcttggaaaaccttcactagcatccagctggattcaggccagtggtgacctttgcagggacagggagctgctactcactcttgctggctggaaggctgggagattaaagctctatgccagagcagatgggactggggaggacctgaggcacagacaggacagcttgttccaggcaccaagaggtgtcagagatgaccaaggcctacacctttcatcagacctgctaggtcagatggagtcaagttccccagacattcactggatggcttatccaatctgtggcaccacactgaaaaacagaaacttctgactaggcccttttcccttgagcctcaggcgttcagaaaaaaaatatcacttaaaatctctggtctcatcaggagggtcacagagggaactaaggggcttcaaaggttaaagagatgtttcttttcttaaattaaatgctagatacatgagaacttacagtatataatgcttataatttatttgtattttaatcaacattcttttacctttacacaatagttaatttaaaaaacaaaaagaaatacagcatatgttcaactccagtctcgtggtagctggctttgcatttggggcattgcagctggcaccagctcggccagcaggctgttctctaacaccacaagtatgcatctgcctgactcatcctgacccaaggctacagaagccagtgactgacatttattcatttatttggtgctgttgtttgttgtttttatcaaaacaaggtttctctgtgtagccctggctatcctggaacttgatctgcagactaggctggccttgaactcagagatctacctgaccctgcctcccaagttctggtgtgattgagcattatacccaaggaagggcctattcttttcttccccactgatcaatataagaaaacagatgaggtgggagcagggagatcaatactggcagcaggtgtttcaaaatgggacatcctataacattaactatattcaactaggaggaaagacttctcaaaatctgagtagacagaaatcagaggtcccaaggcctaggactaaagacatttacaagtgattataataactcatagatgacaagtcccaaacatgagaagtccctatacagtgcaaagtatggcagccactactttccgaagagctttagacaagccatgcccttgcccagtcagtcaatagcagcctctacttatagagtctctactaatagagtctattagatcacccagggttctggaaaccccctcttccttctctgtctcatcatccctgtaggcataaaacaatttattttaagttttaaaaaaacatatatttatttcaatgtctctggatgctaagtctgaagctttaatggtggaaatatgcaggtgatgaccctggttaattattgatgacaagtgcagtactattcatatatttcctttctcaaaattaaaaagatattcatgaaagatactttattttgaaagagaagtctccctatgtggctctggctaaactcaaacttgctatcctcatgcctcagccttttaagtgttggggttaaggacccacaccaggatactctcttcatctggtggatggaaaaggaaaagccagaggctcagaaaggctaaagcagccgcccagaaagtcgggaggcaggctgaagctctagtcagtctataaacagaatcagcaatgtgagattactgcatattgcccctgagaagggacaacactctgtgtaggacagacggctaaggaaaacaacctgcctcagagagagcaagaccagtgcctgaagcttttccttcccacagaccaaggcatgtccacatattctgattgcctcatgattcatcactgggtgattcttgtctgtgaaacgaggatgtcacaagcagaagatgatgctacctccctcagtcagctcagatttgtcaccattccaccaggcccaagcgtcacacctggcctgggcttgtcctacccacttagctgtttacctttactctggggcctacacttacagataggtttcctacttgcagctggtcagtttcacttcctggttgacacccagacaaccccaaaactaacttcctctgaagcttgtacttggagttcatttctgacacagctcccttcccactggaagacagagaatcaggaggataactgggctctgcttccttcaaagggagccttcaaaagcccttctacaggcattcgctaatagttttgtgtcagaatccatggtgggtgctggaaacactgaggcaaaagatatcgccagaagggagcctttagacacagaacagaactaccaagagggatggggggaatatgagcccaaatttgggaaacattgggggcttaagtaacacagaacatttctgagccatattataagagataggtagaattgaggggtctttataggaagtctggttttcaaaacccaaggttacagttgccacttgtccaataggaaacttggccattgtccaataggaagcctggccatatgtagcatcctacatttgaatttaaataaaaacatcagtttctgctggcaccatgactcactctatattctcagtatttaggaagctaagacaggatgactgcttctaaattgagggcagcctgggttacatagtgagcttcaggttagccagggctacagcctaggctgtgtgacaaacaaatgacaacaaacaacaaaatctgtgcataacagtacacctctgtaatcccagatttgagaggtacaggcaggaggaacgggagttcaaggccatcttcagttacatagtaaacacaaggccaatttgggctttatgagaccctatttcaaaaagctgggagtaggagagaaaaacaagaaaaaatttagtctctatattagtagccactgggtatggtcctcattagagaaatcaggctggacagcactgggcaaggctctaagagccaggcttcaatcccagtgtttcacagcagtcacagggccttcaacaagtagctctccctttctgtgcctgttttctcatctgtacctcaagggatgatgcaaagagcaaatgagctaatgactgacaatggtctgtaaatggtagttaatgagctaatgactgacaatgtcaggcgcagtctgtaaatggtagttatctgtgtttccagcactgctcacagcccaggaggcacacgggcacatgcatgtaggttgcctcctctttctcagtgctgcagcacaacaggtgcccagtaaatgctcattaactcccttctcccagctgtttcgcccaagagttagatggactggaatctattttgtgaagagagtcagactactcacatctgtagagatgattccacacagggaagaaagccatgtagagggccacatctcccaccgttggataggacttgaagatagagatgatggcaatctggatgaacatgaagaagatggggtgctccctggagcagggccgggaagacaaacatgcagagagattagccagggaccagtcccactcttagagactcctgacccaccaggccccagtagcacagcagcaaactgcagagatcaagaaattcccagaagtggcaaggaagaacagacaaacaccagtgatacagtttgcaggacactgcccatcaatagccacttcctgtctactagctctgggcctggtccccagaaaccaaatcaagaaagcaaattaagtcagctttccttattagtagcctaaatgactgcttgtcagagaaatcaggcagcctctcccagcaaaggcccttgtcaacaggtccaaaacaggaagtgcctgctggctgatggcttgctcactgaaaatgtggtcagagcaacatgtagacccttactgttaagaccgaggactgaacgttacatgcagcattgctagctcctcaggggccaagaattctctcttttgtgttttagagataggatctcatgtagcacaggctggcctccaactcactatatagttgagaccagccctggacttatgattttcttgcctctactttctaggtgctaggattacaggcaactaccatgtctgtctcagagtggaatttttgggagcttaaactagtaacagctgaactgattttaaattaataaactgccatggctcccatctcctttctttctatactgagttctgtgcagtttctcctgtatcatctcagacgatcctcacagcacctcagccagccctccaggcagagattcctgttccctgtccttcccaggtaaggaaactgaaattcagagaaatgaagtcagtggtatagctgtatgtctacagagctcctgataccactatgttcctctccttggtgcttcacatgtcttgcagcaccagtaaggaggtgggggggcatgcctcgtcctaaagcggcccctctgagaacaccaagagctgaagggaagtgaataggaaaaagccagttacggatccctctcaataaccctcagcacaagcacagggaagactctgcacagagctgatgcctgcttataaggcctttggtcaggggctccgaagccagggtaatggagccacttctgggactactgcaagtgctctcctcagaacttggcacagtccaagtagatgagcagattctggagtcagacaaacctgtgcctgaaccccagctccactgcttgctatctgtgtagctcaagaagaactgttcatctctctgagcaacaatttatcaactataaaactgaatgatggaagtgaaataatgctggccttcaagttgctgagtttgctatcaacccatctcacagcgctatataggtacctgggaagaagcaggctccacaatgacagctcttacactgtagaagtgaactacacagaaagccccatttgaggaaaagtgatcaaagatcaaacagggctgtacatgcccagtctccaaaataacccaattggaatcctttggataaatcataattgagctgttgatcaagaacatccaaccagacccactttccccaaagacatcctcagtgtaacctttgttcttgccgaaatggtgagcagactaaaatgtggccccaggcacctccaggtgagaccagggggaaaccagggctccgaagcatcctccctgcagcctgtacttgtgtgtgaatctcaactgctgaccctggatactggcacatgacaaaaaagtcaaaagcctgatggcaggtggtaccagtccaaaggatagctcaggcaggccacaggagggagggtggacaaataaacagcaggtcctcacacttactttaatttgatggctaaggggactgtgtagaagaagacgttgatctgaaacacgcagacaaaaaagaggctgaagtgctcaaacatctctgcaaagaagtaccagaaaagcccgatgtttggagtgagatctggaacagaaagtctggaattaagaaaacacaaggagagaaaagagaagagttacaaatggtttgctttgccctgcttttcccaagatttgaggtcactactaggcaaccaaggatggcattatccatctaaaggtcacagtagtataaagagctctctatatacctccatacagacaatttacaaaatatagggctgaagatgcccagaatagaagctataatacatactagctcaggactggggatacagctgagttggtagagtgcttgcctagagtgcacaggcccgggcttctacccccaggactgcattaagcccaaatgtaaaaacaggaggatcaaaagtttaaaatcattcttgattagatattgagctcaaggctagaacaggtgacatgagggaataaaaccaaaccccaaaacaagcaaaacaagcaaaaaaaccagctaagctaaaagaatctgaaatgaaaaagggagttccaggacagccaaggctgcacaaagaaaccctgtctcagaaaaacaaaacaaaacaacaataacaacaacaaaaaccccaccaaaacaacaacaacaacaaaagaaatcaagagagcagccctgcttttctacatcaggccagtttacaatcaggagctactcagtattgctagaggaaggagacttaaataaacaaaatctattttgggcattccaaagacttgcccagaggaacaagctccgagagcctgctcctcccagttcttgctccacatccccacagcaggagccagaagactgcatgcctgagcctgcaactgacttttccaagggcttcaggagccatcagcaggttgtgcaaatattcctaggactacagaactcatctgaaaattttgagtttatctaggagacctctgtatagttaaatagcataagaactggctgcaatactggctctttcaaaagctacctatgtgtacacatactctctctctctctctctctctctctctctctctctctctcttggttttgtctttgtttttcagagctgggatggaactcaggacttccacaatgctagaaaggcactctaccactgggctacatcctgagctgtgtgtgtgtttgtgtttgtgtgtctttcaaatgatgaagacagcaaggggcactaggccggcagtgacaagagtattaactgctgcccctaccatattttttatttgaaaaagagcaatgttgaaattaatttgtttataattttattatttttatgttattgggttttttgtttatttgttttgtttttttgtcttttttgagacagggtctcactatgtacccttggctggcctgaaactcactatgtagaccaggctgtacttgaactcacagagatgcctgcctgtgcttcccacgtgctacaattaagggcatatgccaccatacctgtctccaattcataatttaaaaagggcaagtaccttactcatttggtcatcttacaagcctcagaagtgtaatcaaaggtgtaaaagagcagaggtctcaaactttgttccctgttctaccctagtgccaggaatactagagagattaaatttttgatctctatctcatacctattgaattagagcccctagggatgggccagcactctggatttcagaagctgaggagtcttaaaacctgaggacccctgctgtagactgcctgcatagtcttctccctcttactccactaggagctgcaaaaacccaattagcagccgggctttggtgacgcaggcctttaatcccagcacttgggaggcagaggcaggcggatctctgtgagtttgagaccatcctggtctacaagagctagttccaggacagcctccaaagccacagagaagccctgtctcgaaaaacaaaaacaaacaaacaaacaaacaaaaccaaacaaacaaacaaacaaaaaatagcttccaggaatctcttatgaagtttgtactgtagggagagatctgaccacgaccacttgggcgtggtcacaagtatgtagaaggcatgtggaataaagagttgaggagaaggggactccctctcttttcggggttctggttggatctcagaggactgtggaaactagagcacggagcaccaatcgggttatcagtattgcatgtgagagattttaataaattgagcatctatatccatatcccattaacactgtacttacatgaatccatagaccgcagggatgaaatcccaagagctgagaaggaagaaggagaggcaaactatcaccacaaggcttcctatatacatcatggcatactcccaagagaagatccagaaggctttgctcttcactttcacagggatgtactgccgctaggagagaggccagaataggacatttagggacaccaaggacaaaaaacacctctcagcttatacataaagatccctcctataaaaatcaagccatggcacataggtttacaattttgctgtttccttcctttctttctgttttttttgttttttcgagacagggtttctctatacagccctgactgtctggaaatagctctgtaaatcaaggctggcctctaactcacagagatccgcctgcttctgcctccaaagtgctgggactaaggatgtatgttgcccctgccaccactcagccctgatacttttcttatatcagaaaaaaaatacaaatgttttgaaaaaaggtattaagaatggatgagacctcctatcactattccaggtgtgcattctggagatgtgcacaaaataccaatgagaagataatcactgaaccaggaagaaagcatggactgtggagcaacgggacaatggcatgctagcaatgacatgtaaactgcacctatgtatgtccacatagctaagtctcaacattcgagggtatagcacaaacttgccaaataatcgatagaaaataataacattcatgctatcttgaaattacacccaacaatattatgtattatttatacatatgtaggactttaagcataaaaattttatgaagcatattagaaggacatacattggccagcaagatggcttggtggttaagagcacttgcaccacacctgctagcttgagtttaatccctgagatccacatggtggaaaagagaaccaaatcctacaagatgtccactgacaatctcatatgcactgtggcatacgtgtgccatcaccacaaaaaatacattaaggccagcctggtctacatatcaagttccaagccagccagagatacacaatgataacttatccctgttcttcccataaaaagcaagtatgaaataaaatggtaataaaaaatctttctttctttttacttcgagaccctgtttaaaaataactggtgggaggggttaatatttctctgcctttcacaagaaagaaaaactaaaaatcaaacaacatatcaaaaggtgtgtattgaggctcacacctgtgaactctcagtgttacagagtctggggtaaaaggattcccaagaattcaagactagccctggctacattgttgtgtgatattttgattgtgttctgacaaagtttgcttggagtcagagggcagagctaccacgagctgaccgtagaggcctggaggactgtagatggggagacataagtagggaagcagggcagagagaagatctcagcccctttgcatggaggaactgaagatataggaaataactggtggctgctccttgttctctgatctttcaggttcttaccccaatatttgacttttgattctttattgataaagagtaaattagattaatgcttcacctggcatccacaaattcacaagacagccactagcccctggctttgaaaccattggcaaccaatggagctgtacacgcaggagcctctgtgccaccagctggcttttcctttctttctccaagtcctctaagctagtctgggattttcctgttgcagcctctttacagaaatctccacaagccccagactctacaggcgcctgcactccaaataccactgctggagttagtccttcataaccagtcagctctgccttcatgcagttccctccacaagtgatccttctgcacaatcccatgtgtgtttttcagacagccagctccctttcgatgtggactgcaggcttccccaggacctgctcctcaggctgctgcaacactaggtagcagccttcacatcactcaagcttctattattgttgcaaccgccacacactctcagctcacagctaaaggtgagcagctgcagctgctctcagccaagctgtgcaccacctgttttgtctgcccagatgtgctatgcagtgacagccagcctcatacttcactgtcatcatcatcagagctggtgagacacctgggaattattaaaggggagaattagtttaaaaggaaggaagcaaggaaggaaggaaggatggaaggaaggaaggaaggaagggagaaagagagaaagaggtgttttttttttttttaccacattgaaaaatgggaaacactattacaaacagagggagttaggtctctgtatgattctgaaatggacagtttaattagccgggcggtggttgcgcacacctttaatcccagcactgtgggaggcagaggcaggtggatctctgtgagttcgagaccagcctggtctacgagagctagttccaggacagtctccaaagccacagagaaaccccgccttaaaaaacaaaacaaacaacaacaacaacaacaataataataataataggaacaattaatgagggtttaattaacttagctgtgatttacataatgttaattataaacattatgggtttggtaattcttattttatccctaaaaaagttgcttgatatgagtgccaagatacagaccttagaaaaggttactaaagaaaataatgtaattttgactgataaattacaagccttagaaaaacttaataaaacagatagagatattcagacaaagaaaggaatttaaaggctaactaacctcaccatgacattataaaattagaggaacagcctaaggttataaaaaaaaaaaaagccaaccttaatttatctagtaactatacaggaacaactgccaaatgacagatatccccaagactaaggaagagctgactggattcctatgtaaatgttagatttgaggagatttaaggacttgatagtctcatgtgctacgcattcaccttttgtgaggcagatgtgaaattcatggtcaactagtaacagaattatcccacacaattttcttagaaagacttggttatagcagtatcagaacctggtcttcaactgcagtggaggacctggagaaaagatgaggctaggacctttgaacaacaaagtagggctagaggtatggaaatttcccaagcccaacttcctggagagggcaactatgctgacgtgtaaagacggtctatatctgatgaccatgccttggctctatgctgtacagcagccttgaatgcttgaggcagagttgaagaagtaagaaagagaactgagtcatttactaaagttacacagggcccaaaagaaaccttcattgatttttcacagagattgacttcagcagtaagtagaatgataccaaactcagaacctagacaaataataattgaatctttggcttttgaaaatgctaattcacaatgtaaaagggtaattaggcctttaaaggcaagatcaggacccacagaggaatggatccaagatacaatcaatattgaatctcataaccatgatgatgtttggataggagaggtgatttccgaggcttggaaaaaaaaatcaaaatgtcaagtgttttgtttttgtttttttgttaatttttgttgggggggggagttttgagacagggtttctctgtggctttggaggctgtcctggaactatctcttgtagaccaggctggtcttgaactcagagatgcgcgtgcctcagcctcccgagtggtgggattaaaggcgttcgttacctccgcctggcatcaggtgttttaattgtggcaaacaaggtattctaaaaagagactgtaggcagggtgttcctaggaacaatgttttttctaggaataatcaaaacacaagacccctaccttctggagtatgcagaaagtgtggcaaaggacattagaccaatgaatgtagatcaacaagggacagaaaaggaaaccctttgccatcaggaaaacacctggagggggggctactctcataggcctctatgtcaaatttggttcaattgttgcctgtcaattaaaggacctactgtaaaaaaaaccatactacacggggtgatagaacagctttaaaagataaaacaaaacttttagaaccataaagcaaataccataaacactagatttgaacaagagagacctcttgattagaaaaggtgatagttcatcaaacaatatgactactcaatctaaaataatttaaagatttgtatatttattatgtatacagagttctgctagcatgtcagaagaaggcaccaaatcactttacagatggttgtgagccaccatgtgattgctgggaattgaactcaggacctatggaagaggaatcagtactcttaacctctaggtcatctctccagccctctatctaaaataacttaaagactaacaaatgtttttaatttaatcagatataacttgccaagtgggaaactcccaaagttagggttggagcagagttttgtttttgtctttccaggagaataaaggcatccaactaaggaatctgaagacctggaaaaataatacatctggagaaaaaggacaaatcatccagagaaaatatcccaaggaaaagagtaaacgggccatttccaacaggataaaatttcatgtatcttcccaaatgtttgtttcttctgttctctacagatatataatgcagatggtatttttgttgttgttgttgttttgagacagggtttccctgtggctttggaggctgtcctggaactagctcttgtagatcaggctggtcttgaactcacagagatccacctgcctctgcctcccaagtgctgggattaaaggtgtgtcctaccacccgcctggctgcagatggtagttttatagtccctgtttaattaaaaattaagcaagctttggagttggagatcatttctccttctctaaacccaagcatgcttgttaaagtaaaatccaaaatctctgtttcatgtcagaagagccacctgatatgggacagaagaaaaaccaaaattaaggactattctattgccactaaacaatcctttggtattattttgactccttaaaacttttcttaggatataaatatctcaaattttataaaatttgtatacatatatgtttttaaatttcctgttatgatattaatggtcatacagagtactaactaattatagaaaaaggcttcatctagcttccagttcatgattttgggtttgagtctctatcagataactaggaattaagcttttgtactctggatgtacataataaattatggtactttaaccttttcaagatctgctgtatattatatttaaaatgtttaagttttctgcagtgaatcatgaccatgcttaacagcaacctttgaagtctccaaaaggagaatgaggccctacaatgacaatcccaccaggactatgataacctcactaaactgacaaacatcacctaaagaatgactttggactacaaactgttcaggacaattttaaggtggctagctgagatgatccagcctcacagactactatacctaggacttgagataagtctgcatttccccatttcacagagactgagcaacaaatgatacacttagctctcccaggacttgacaattatcctaatttttttcagggtcccctaaagatactgtcacccccagagagcaggaagtaattttaagaacatgacaaccacattcccaagaggtggggtgggcagtttttgggtggattatggatatttgtcattatttagcagtattggttacacattgctattggtagtagtcaagaaaaaggagacaaagaagatatttatatcctaacaaaggagattagttagactcagggatcttgttctgaaaagaaaaagcagtgatatagaaaggataggataaaagagtagattattttaaaccaaaaaaaaaaaaaccaactactagtcttaaatattttatatggtatttttgtatattgatacaaatttgagggtatttttgttagaacctactgtacctgcatttctactcttgtttaaggtattttaactatgtaactcacttaatgaaaattttagtccttgaaagttattaatacaaactatttaggataataaagaaatgcggttagtagtcacctattgcaatcaaacttgtagtcatgttaggtatattttcaaatatcaaatatcaaatatcaaatagagatatattttagacaggtagtcttcaaacacttcagaatctacagaatatggcttttaagatgtgttattagccggacgttggtggcgcacgcctttaatcccagcacttgggaggcagaggcaggtggatctctgtgagttcgaggccagcctggtctccagagcgagtgccaggataggctccaaagctcacagagaaaccctgtctcgaaaaaccaaaaaaaaaaaaaaatgtgttattaacacaaggttatttttttgttatgacaatgagacacacctgcttctggcagtgccaatctactttagagaagatgatgggcatcaaagaaactccatacagagtttactttctttgtggcaaatgttagccacttcgcaagaaactgccattgccttgactgctgacagtatgctgtccaaattggaaaatcgggacacacgaaaatatgactgccaaattttgccaagacaaggcaggacagtccttcaaaaatcctgcttcatagaaaagtttgtcagatatccgaggcctgtaggccaaagatggatgcctcaatgttacagacaaaccttggatgactatccaggcagccagctgtttctgtgagttcttagttctgaaagttgtttgcattgcacttcctgttttctcaagtaatagtatatccttctcaggtctctgatggagttaaagactagatatagttttccttgttaccaaattcagaaaagaaactcacaaaaatgtgtaaagtgtataaggttgagggacataaaagatagttctgggttggtaatgcaagttatgatagaaaataaattaggtacaagactctggactcaccaagataggatagatatgggatattttctctgaatttgtcaaatgcaaatgaactaaatcttgttaattattgtctatatatatttgtatatacttattgtacttattgtatgtagttttactatgttagttaaaacattttgtttttatttaaacaaaaaagggggaaatgttgtgtgatattttgattgtgttctgacaaataaagctttcagagggcagagctaggcactagctaaccacagaggtttggaagactgtacagagaggagacatgaagtagcaaggtgggacagagagaatctcagccccttttggatggaggaactgaagaggtaggaagcaactagcaactaccccctgttctctgatctttcaggttcttaccccaaaatttaactcctgattcttaattgataaaaattcattagattaacacttcactacaccttgagaccttgtatcaaaaaaataagtaaaatgttagtggatgaaattctgaaaggaaacagacttgtttaatctcaaattatctttctgaaagtactaattacaagaaaaacccagggtggccaagcccgacgacctgagtttgacccccaagacccatatgggagaaggagagaactgctcaaagttgtcctttgacctcctcgtgtacactgtgtcatgtacacacatagtaagtacactagggaggctgaagtgagccaagtacagtatactacgcctcacaacatggaacgtgttcaaaagcactgccggccagacctcacaggtggactacctggaagtcttttttttttgagacagggtttccctgtggctttggaggctgtcctggaactagctcttgtaggccaggctggtctcgaactcacagagatccacctgcctctgcctcctgagtgctgggattaaaggcgtgtgccaccaacacccagctctggaagaagtcttacacaagaaacatttttatttcacccacatcatattctgggatagaactgtgcatggtgcctcatacctatttgtcctgataattgaaggctgagacaggaggattgctgagagttcaaagccagactgagctagtgaatgagttccaggtcagcctgggcaacaatgtgagaccctgtctcaaaaaaagataaaagtaaaactaaagttatagaacatgcaaaattacaattttttttgaagtccagaataggtttcattatggcatttttctttttttacagatttatttattttatgtgtacgggcattttgtctgcatgtatgtttgtgtgccatgcgcatgcctggtactgagcaaggtgctggatcccctggaactataattgtggatgtttgtgagccatcatatgggtgctgagaagcaaacctgcctctccacgggctcgtgacacaggtgtgcaccatcacactcacctttcattatggcgctttcacgtgtgtcactgtactttgctttaatttatatctccaatgccctcttttccacccctgttcatctctggctagttcttactgcaccctggaaaattctcccttccacttacatatgacatgtattctattatctgcatacaagttccagactgtcacaaaacaaacaaaacgtaaaacagcaagggacctctgctgctctactcttcttatctcatctttccccccttaaatgtgctgacactaagccacctgtgactatttaaattaatgaaaaatataaatgaaattcactttagtctcactagcacttaggggagggagtttggagacagggtttctctgtgtagccctggttgtcctagaactcactatgtagagcaggctggcctccaactcagagatgtgcctgccactaacactttttgcaagtgttcaacagccaaatgtggcatatgcctattgtactttctgactgataaattttgtgattactgtatagtgtgtgacttctatactttgtgtgcatatgactactctattgactaagtaagtgaacatttccatcatcataaaaagttctatcgggagctaaagaggtagctcattgattaatagcactggctgttcttccagagaacccaggttcaatttctagcacctatatagcaattcacaactgtctgtaattccagttccaggggatcagacactctagcacagacaaacatgcaggcaaaataccaatgcacataaaatgaaaaataaatcaattatttttaaaagccagaaatgggaatttttaacataaattttgaaaaatacaactttgcatgtgtgtgggggatgtgtatatgtatgcttacatataaggggtggggtcacctatgtgcatgtgaaggcagaggctgacactggatgtctgctatcagcccgagctcatggcttggccagtctagttagccagcttgtttcagggactcccttactctatgtctcaagtgctggattatacgtggtctgctgtgctcactctgaatttatgtgtgttctggggtcccaaattttaagtccttccacttacaggtcaagtgctttacccactgaaccacttccccaatcccacttacaacttattgtctaagattaaatgaaatgaaatgaaaattaaatactaagatgaactaaacctatctgtggccacatatgggtcatggatatatatacaccatcaaactgaaaattttaaacaatacctacaatatcccaaaagcataaatagagacaatacttctcaagctgattattatgggcttctcatgacaggaaaaccaaaccttattacagaagggagagggttttttcagagctagacactgaccctagatccttgtacatgtggcactagtgttccaacagttgagaaatgaatttccctctccttaatgctctaaaacatttccatagaaactattttctctcacaacatgaaaagggaaaggctagttatcagaatcaagtctttaaagggagctgaaaccaaataatggttttatatttaagctcttgggatcttaaaacaagagcccataggtggctgatggctgtaattccagcactcaggacatgcggacaagtgatacctgcaacaagctgactagtagagtagacaaattggggaactatgggttcaaatgagataccctgtgccaattaaagtgggaagagcccaaggaaatcatccaataccatcctctggcacctacaagcagacacacatgtgatcacgtgcatctgcatacacacctacctcccacatatgtaaacaaaactacatgcacgtatacacatgaaaaagattgcattttaaacttgcatttcctcctatttgtttgtacatatgtttgtctttgtgactgtgcacacatatgtgtgtgtgtgtgtgtacctgaatgcagaggaaaaccgtgaacagtggtactgttccttagggactgctcactttttttttttttttttttggtttttgagtcagtgtttctctgtgaaacagtcctggctgtcccagaactcactctgtaaacaaggctggctttgaacttacaaactcagagagatctgcctgcttctgcctccccaagagctgggtctaaaggcatgagccactactgcctgctctttttgtttgtttgtttgtttgtttgttttgttttgctttgtttttttgagaaagggtctctcactagcctggaacacaacaagaaagctagaatagctgactattgaggcaaaaggattagaagtatagtgattcataaatacatgaacaatctgacttatattttgcctatttgtaaaaaggaaaaagcaaacagccctgctacctcagccctggagaccttctggatgcagaacaaacagaaagctgttaggggaacagagcagggtgtaaaaattctaaataagcgcctcctgaagaaggcctgggaagaatgcagctatcaagaaaaacctgatgggattgactcccttgtgaggcatataaaatgacctatcccaagacatagaaaaatatggcaatcacaggcttaacttcaattcaaagacaaaaggtcagattgtattaaagaaaaaagaaaagtcaaaagagcgcctgcaagctaattccccagtgtctgttactgtcattgaaaaagaggacggtctcaaaccccaaggctttaggaattccaagaaaatgctctctctggcagtgccatatgctaaaattggaagaatacagagactggcatggcccctgtgcagggatgacacacatatttgtcaagtgttcaatattttaagatgctttgaagttcaataaagcatgtaggagactttagccagagagagagagagagagagagagagagagagagaatcccaaacaaaaaggaagagggaaaagaaacttcctggattgtgctaggagttcccttaacccccaaactctagtctccctcaccagcatcacagtctcaagatttttttatttattttcttttcccattctgttcctttgttatttttgtttgttttgttttgtttttttgctatgtagcccatgccggccccggacctctttatgtaatcagactggtctcaaactcttaacaatccccctgcctcagtaacctgagtgctaaagttacaaatacacatcaccacaaagggtaaaaagctcagcttgttttccactgtgggccccaatgctgtacatactagggctctctgttttattttgcgtgctatcagatcataacactgtaagcatctctctaatttggaaagtaggctccaagccaaggtcaaaagaagagcagagttgggggaaggcaccagatgggctcaaactatcattttcatcagtgactcaccagggagccagatacagcatcccttcttttgaccccatatctcctaagagaacagaaaaaagtctttccctttggttctgatgacacactagcttatccactatctacattttggtctctagaaacaaccagaagaatggaggcaggtttatggtgtcaaaagaagaaatacaaactaattttacagttcttttgattctagaaaagaagtaatttcctttcccttcatcacccctcatatttacaagccggtgactaagtcctttccatgaccaaatcattgccatttgaataccaaataactacatctactgaactctcattagactgtattctagacacacaacatgtattaaccttttcaacatgtactattattctattttaattttttattaataattattattattgtgtgtatgcgcacattcctatatgcctatgtgtgtcatacgtaagcatggcatgtccatgccatgttgtgagtgtagaagtcagaaaaccatgttggaaataaggactcttcttccattgtaggttcaggggatctaacttgggatgtcgggcttacgtggcaagtgagttacaggctgatccatcttggtggcccattatcctactttataattgaggaaactgaagaggaaagccaagagtatccaaactacatgagtccacatgtatcctattcctttgtttcttattctgaaaattttcaagtatgcaaaaaatttgaaatgatacaattatcaaacatttatcatctagcctatttctgttttttcattttatctagtttaaatgttaataccttgctacattcaggctcaggttttctttttatatttccagttacatttgtttattatttgtgtgtatgtatatgtgttacagtgtatgtgtggaagtacacatacaactgtggaaattggtttgctctcctcagttatgttctggggatataacccaggccatcagacttggaggtaaacaccctgaaccagatgaaccatcttgctggtccaggtcagatttcctaaaggataaagtatacatataaaagatgaaagaagctgtgcatggtggggtgcaaacctttaatcccagcactggggaggcagaggcaggaggagaaagcaaggaggaaaggaaggaaggaaggaaggaaggaaggaaggaaggaaggaagacaggggaggaaatgcacaggctatggcgttgtctccgtggctaaaatgctcgctgcacaagcttgaggacttgagctcagatccccagcatccctaaaaagtctagcatggtgtcatgaacctgtaatcccagctctgaggaggcagacaaggggatcttgggagcttgctggccagccagtccagctgaatcagtgagcttcagattcagtgagaccctctcagaaaataaagtgaagacaccaggcatggtggtgcatgaccttaatcccagtctagggagacagaggcaggcaaacttctgtgaatttgaggccagcctggtctacacagtgagttccaggtcacctaaaaccacatactaagtctctgtctcaaaaaaaaaaaaaaaaaaaccccatttggacctctggcccccacatgtacacatataggcatgtacacttacacataatatctctctctctctctctctctctctctctctctctctctctctctctctctctctctctctctctcacacacacacacacacacacacacacacacacacagcaaatacacactaattatgtgggaaaggcttgaattcaacaagaacataaaagaaaatcaaaacaaagtaacttcaccatataatgatttgtctattaaactagcaaccacaaatctaatttgaaaagtcagtgccagcagacaaagagacagttcacgcctctgtggatactgcaggtgacaccacaggctggctcaagatttctgatgaacactctggtttttgcatataataactaaaactttttgcagcctttgatccaattagaaaataacagagaaaaaaacttgtcattggctagggagagggatcagaaagtgagagcttactttctctgtgctagcacaaagacccaagtccaaattcccacactcacataaaaagccaggcatggctgcaaacccacctgtaaccctagcactactcggggtgcagacaagacgattgatccatggggccttttgactaccagcctagctccaggttcagtggaaaacctgtctcaagggaataaggagaagaatgctagaacagggtacccaatgtcctcttctagcccctggatgttcacacggacatacacaccaacacatgaccacacatacacatgtatatacaaaaaaaaaaagaagagtaaaaaggatggaaggaaggtatataaaggaaggaaagaaggagtaaaaaaaggatgaatgaatttcaagctggcctggtaataaaagtctgttatcccagttactcagaagtcctccttacattgtgagtataaagctagcttgggtaatttagtagatggcatttcaatttttttttgttttgttttgttttgttttgtttttcgagacagggtttctctgtgtaacagccctagctgtcctggaactagttctgtagatcaggctggcctcaactcacagagatccacctgcctctgccttccaaatgctaggattaaaggtgtgtgccaccacccagcggtatttcaaattttttaaaaagaagaaaagggttgaggatctggcttagtggtagagcacttgactgttgtgggtccagccctacattcaattctcagtataaaaaaaaaaaaaagaaaaacaaatttctactacacacacatactactaacaataaacaggtatctcaagttctacgaacaaaagaattaaccttttaccactatattcatcaatctgactccatattatcaagtcacttaaaatgataagcacagggcctgttttaatgagtggaggtgtgcaatctgccctggctacaaaccactcttctgtatgtgaatcccagtgctgccagtacactttgagcaaacttctcttctaagaatgaacttggattcctttgagtccctgttttttttttttttttttttttaatggggtagggtgagtagtcaaggatcaaactcagagcctttcatgaatgatgactgttgtgctctacttccacactacatcccaagttcgacgtgtatatttataagctgaaaataagagacggttggaaagcaaactcctgagtcagactacctgaactcttagctcagtgctgcatctgatggtttagatgactgaacctcctgacattctagttttaattcatgtgtctaaataaaatatatttagttactctgtggctgagaatagaatctaccccattaagttctttaaagttgatatacgatgatgactgcagagggcttaacataagtatttcacatgtaggttattctccacaaatatcagcactttatattcaattattgtggtcggtagtgaccactatgttcttgccatggcaaagtggcctaggttccaaagtagtgcagaagtcagccaggtgtaatgatgtaaggctggttggtgccttacaccaacaatacctaccatcactttcaccagtgtgcagtcaactgcttattgaaaatagcagacactatttaaaatttgccattttaggaaactagagaggtggctcactggctgcttttccagaggacccagattctattcccaacaccacatggcagctcacagctgctgtaactccagttccagggaatctggtgccctcacataaacatatatacaggtgaaatgctaatgcacataaaaataaatctttaattaaaaaattgccatttttgtaatcactattaagaaccttacaagataagtgtaattattaagaaaaaaacaaaacaaaacaaaaccatgagctcaaagaggtatatgcacattaagtgaaacaaagaaaatgtctgtccagtgtttagtggatgccaactctaagttaactgtccctacacacttgcaatgacagacacagttaaaacttggccattaagtctcctttgtttcatgttagtctgctttttcaaatacaagtgggaaggcccaatcccagcaacactttgaaacgtctgctttgttttgtttgtggcatgagggactgaagcagggccccatgtatgtgaggcaaacatcacatccaaccactgagctacatccctagctccaaatgctgctggtgacccatgccattcctcccccaacccccagaaggggccaggcaatgtactaaatatcacttgggcactggcaccagcaagcgcttacctggaggagatagagaagtcctggggcaaacaaggtgactgggtatagagtctggtatgttgctaaggcaagaaaaatagcactgaggaaaacactgcctgtgaaaagaaacaaaggtgtagaataacccagcctcgtcaatcaagatttcactcagcaagtccacatcaacatgaaactcctaactgctcaattacctgccaagtgcttcctgatatgcaaagtactctgcaaactcaacagaatgaaagctcttggcttagttcccttgaaaggaaatcaaggaagtcaaaatcacctgcctttaacaaactgtgatgtcacagacatgtttcttaagatttttttcagatccagaaagatttttataaaacctcagcccagggctggagagatggctcagtggttaagagcactgactgctcttccagaggacctggggttcaattcccaggacacacatgcagctccaatatctgacactctcacacagacatacaagcaggcataacaccaatgtacataaaataaaaacaaattggaggctggagatatggctcagtggttaagagtactgactgctcttccagaggacctgggttcaatttccagcacccacatgacagctcacaactgtctggaactgtcagttacaggggatctgacattctcacaccaatgcacataaaataaaattaaatttaaaaaaataaaaataaataaataagctgggcattggtggcacatgcctttaatcccaacacttgggaggcagaggcaggcggatctctgtgagttcaagatcagcctggtctactgagtgagttccaggacaggctccaaagctaggcagagaaaccctgtttcgaaaaaccaaaataaataaataaataaataaacaaattgcaaaaaccaaaacacataataaaactcagcccaaagatttacaagtagacaacaactattaacatccatgtcaattgcgccaagttattaaatctgcaattactgttcatgaaattcagagctgtgaaacctagccctctggatttcacaacagctcatcactctgtaatacctttatcttgaagccacttttttttttctaataaaaacattattgatgctttatttttggtttcactttgtagcctaaactggcaccaaccttgcagttatctaagtcctccaagtactggggtaacaaacataagccaccatatccacatctagctaagagtacattccttttattaatgagtctactccctacacaaaacagactactagggagtcattaagcatgcaatgaaagaatctgtgatgatacgtatctaaaaagatacggaaatacattgttaagtagaactttagagatacatacagtttatgccatcagaccccactgttttctttgaaaactttaaaatgaacataggccaaggctacaccgagaaactgtctcaaaaaaacaaaacaaaacaaaacagaacatatccaggtggtggtagtgcacatctttaatcccaacattcaggaggcagagggaggcagatatctgagttcaaggccatcctgatctacagagtgagttccaggacagccagggctacacagagaaacactagaaaccctgtctcaaaaaaccaaagagtgtgctttgtttgtactataggaaaggcattaatttttctatttgaaaatacacaaacaagcaaacaacagttattccctttcagatgtattaagacaactaggtactttcatagcaaggggagaggtgacctagaaatcagttgacatagtggttcaaagtgcatgtctcatatgattatggtttataaaacaatagtgtaatggctgtgactgtcctggaactcactctgttgagcaggttggccttgaactcacagagatccacctgcctctgcctcctgagtgctggggtcaactcttctcaatgatgtttcacaagaagaggaacccctcagtctactcaatctgaggaagcttaccactttcccaacctagctccagggagacatagagagaggtgatcaatatgctcttttactcactaaagtagtctatttacttgatggcaatctcaccacaccctctagtggtctatagacttgaaacatagaagaatcaccttgggaaaagagacaggatatgggggagaagaacgaatgagaataaagtataatgacacacagatgaactgtctgtcacaatgaaatcattattttgggttttgttttgtttttttcttgacacagggcttctctgtgtagctttggagcctgtcctgaaattcactctgtaagccaggcttgcctcaaacttagagacccatccacctgcctctacctcccaagtgctgggactaaagtctttgctgccatcacccagcttgtatgttaatcttttttgtttgtttctttgtttttgtttttccaaacagggtttctgtcctggaactagctcttgtagaccaggctggtcttgaactcacagagatccacctgcctctgactcccaagtgctgggattaaaggcatgtgataaccttaaaaacagatttaaaaaaaaaaaaaaaaaaagatgagaaagtagaaaagaaggactctgtaactataaacaagaatgatcatggtggacagtacagtaagtaggaagaaggcagacaaaggaggaagttggatgtaaacaacaaagaacagaattcctgcatcaaggctgtcccactgtatggggtgaagtcaagatgttcgcaatttcaggtacttgctaaaacaactgagcagagatagggacaggcctagccaagtcctgataccagaagaggcctcctcccacctactcagctacacagatctggaaccagaaccaggtcaccctgagacagggatgtgccagccataagaaaggtgctttgctacaggctcaaagcaaagtaagctcaggattctctgacctggccaaaaaaatgcctaacaacttgtagaaaattggctaagagtgtagaaatgttagagagaattttttatttcacaagcttttcaacatatttggtagttggagagaggaaaacccattaaatgttgtcagagtggggaggctattgttccgcttcattcattcatacaaaggaggtaaaaacacaaaccttcaccccactctctgccccaggagacaccagagagtgaaataaacacagtcacctcctgccctaattgcctaagatcaataactgcttgtctggaacagctgtctgtaagacccaagagaggaaaaaaaggctaatacaggaacagaatgaatttagaaatgtcttagaaaatgtgctctgaggaacaagaagtagcctaccttcctttttattattagttaattaattaatttagagacagagtctctctatatagccctggctatcctagaacttactatctagaccaggctcatagatatccacctgcctctgattcctgagtgctaggactaaatgcattcgccaccacactcagccctagggtgacatcttaatttttttttttaattagtactagggattgcaacccaggaccttgctgggcaagtgctctaccactgagctccattcccagtgcctagatagaaatcttaggaagaataatctgttccacctgctttctattaacaagtccagctggacacctcatctccacattccttcttacaccagttcccacgcccacagccccacctctcaggtacgacagacagttcatactctcatctaccatcagtgctcagcagtctctcttttcttggcccctccttcacagaagcaccaaaagactcttctgaagcagacagtgacttatctaagactaagccaggtatggcagtgcacacctataatgtcagcactcctagatgcaagacaggagggtcaggagctcaaggacacctttggcttagttgaaaccagcctgggctgcatgagaccctatctcaaaaacaaaaaaagtcttttcccaatactgccatacatttcccaatacattgaggctcaagtgcattcaagattggacttcacctataacccactgctcttttcctgtcatccttcagtggcatgtgtaacccaagcagagttaacaacagtagtgactgctccgttactaggtgccatgtatatgcattgtgtaatgtctacctcaaaaatgtgccagactcaaagaggccctggggggaagcagcacagcagacttgggaaagaactgttctcagctcattttcttgtgacacataaaatgtgataaaaatcacataatctattcatttcactaatgaagaaaccaaggcacagaagcaaggttaagttaaaaaacaaaaaacaaaaaacaaacctaaggctgcccaactgcccccaactcttgctaagcagcatcatctgctgtcttctagcaatgccgtgggaatttctcaagggcagtaagtctttcttaattttgagtctcttctacctttcgaagcagacacaatgaatgaataactgactgactgaatgaacatcattcagtaatacacaggagatccttttaaaaagcacatagctgggtgtggttgcccacacctttgattccagcaggcagatctctgtgagtttgaagccagcctggtctacaagggaagttccaggacagccagggccacacagagaaatcttggggggacagacagacagggaaggaaggaaggaaggaaggaaggaaggaaggaaggaaggaaggaaggaaggaaggaaggaggaaggcaggcaggcaaacacattaaagtaaaccaacacccgtgaggaagaccccacaaagctttaaacagaacattatgtttaatgttatgtaacattaggaagacataacacaaacctgactttaggatggaacaaatcttccagattagcaattgagggctcctaatgccaggggcctgccatggggatgctttctagaataatgatggctgaggcccgaattctggggcaaaagcacagtgctactgtagccagtggcctggtatctgatgacaagacaggcatagatgtggcatatgcatagcctatgcaaagggaagagggcatatggaggtacacaagatttgaagaaatctaaaaagggcaagaagaatgaaaaaggcattgagttagaatgaaacgtggttggcacaggggcagagaagatgaaaaaaaagtaaaattaggttatcaaatattttagacaaactgtgcaataagcaaaccctgcccgagtttgctctgtgtcaaacccagattgagaggtagaatgttaccagcacccacaagagacacctcactcccttttttctttttgatacagggtcttatgcagctagaactggccttgggcttacaatgcagttgaggacgaccttgaacttctgatattcctgtctctactttccaaatgctatgacctcaggcataggccaccacctctagtttatgcattgcaaaggattatgtcagctaggcaaacactctaccaactgggctacatccccagcccagtttttatatttttcatttacacctagtatacttcaataaaagttacaatctgccatctaaagtcacaacaagcagacagagatcacagcataaagggtttagttccaaaaataattcaaataactatgggtctacaactgaaataatggctaaccaggaggagcagtgccaagagggatatgagttttacccctaaacgatacaaggtactagtgtttgctagtgcagcccatataagcattaggtttcatgagcaaagctttacctttggcctgatcacagaaacattaggataaactagctgaattgatataaggactggctgccatatcagggaatgaacagcattacccaaactctgaatatgttttccaactctctgtatcagggtgggggccaaaacaagcctctgcaagaaggtgcctctggggactacaccttcatgagggcctgggtgggtggcaccacagaagggcagagcaggaaagagacacaggaatgaaacaaggaaaagccaggggactgactcagtatacgggttagcaagggatacacagagtcagagactgggtcagacagtgacctgtcccaggcagactggcagtgggacagactgaaatactgaccaaaagggctgaggtccctcaggactatcagaaaaggaaattgcaccagcatctgaggcaacaggagcagctaggaacagagtccactgcacttacatcccttaacagggcagtctgtctcaagggagtctaaccacaccagcaatgaagaaacattgagaacctgctctgttccagactcgactgtgagcacgccacatgccgtcaaaagtatacctttcaataacttaccatccctattttatagatcaggatctaggatgacagaaaggggatataagcctggacaagctcactccagaccatctcaaaaagacaaattaaataaagtgaattatcctatctttaactgtactatttatgcaatgcaaatgtgaaatacagaaacagagcttggagaatgtaaaactgatttagttttactgaataaattattactaggcattactaatatacttgaaaagtcaacgtggttcagagagatgtagctaatagaggattgttcaaatactttaatagattaggaacactatgacagtctctctatagcatacaacaatgcaaaacaaatgtccagcaatagggaagagcaaggcttcagagcaaatgtgtatgagaaatggagatgagggtagggttcagaaagacttgctttttgtttactatgcttaaatttcttttattcttaccatgtgcctgaattattcataatttctaaaattaaaatttaaagtataaaggaaataacaaatttgtgtttaatgtctgtattactttagaaagtttattaaccaacacacacaatttatgaagtactgggaattgaacccaggacttcgtgccttcgtgcatgctaggtaagtgctctatcaagtgaactacatccccaaccctctgtattactttaggataggttctcaaaagtagaacaaataagccagatattatgacacacccctttaatcccgacacttgggaggcagaggcaggtagatctctatgagttcaagaccagtctggtgtacagagtgagttccagaacaaccagagcttcacaaagactctatctcaaaaaaagaaagaaagaaagaaagaaagaaagaaagaaagaaagaaagaaagaaagaaagaaagaaagaaaagaaaagaaaagaaaaagtagaataaaaaattgtatttttctttttttgagacaggttttctctgtggctttggaggctgtcctggaactagctttttgtagaccaggctggtctcgaactcacagagatctgcctgcctctgcctctgtctcccgagtgctgggactaaaggcatgtgccaccaccgcccggcccaaaatacaaacattttaagaccactgataagagtcctcccagaagggtcatacaaatgtgttaagtcaactggtaatgttcataaaatattaaacaaaattatgtgtgtaacattgaaaaaatggctatgaattcattcaacagaaatccagacatataataaaaaagcttccctgtgggaccaaaactgtaggtctgagattttcttggaacctttcactgacagtttaaaaaaaataaaattgtgtatgtccacaaagggaatatggaaaccataggagaacttgtgagagttgggtctctccttacatcatgtgggtcctgggaatcaaattcaggttgtcaacttggtggcaggcaccttaacatactgaggcaacttggaagctcttcctacggtttgtttgtttggtaaacaggctctcatgtaactcaggctggcctcaaacttcccacactaaagctgaggatgactttgaaatcctgaccctcaggtgtttatctccccaagcctgaccacactatgctaccatggctgacattacttttaaaacttttgagacagggcctacgttaataggctggcctctgatgtactatgtaagcaaaggtagaccttgaacttgtgaccctactaccttagtcttttgagtagctctttaaaagtgatatatcaataataataacaacaataacagccataataataataaacaaaagtgacatttttagcactggctatggtgacacataacccagctacttaggaagctgagcaagatgggtcccttgaacctaaaagctgaaggctaacctggacaatatcacaagacctctaatcaggtaaaaaaaaaaaaaaaaaaaaaaaaaaaaaaaaaaaaaaattaaaaagggataataataattagaaaggtgacatttccaaataagagatatgcagcatatcttattctggtggacagaataagcctataatatgctcagcctatctgagcttggcactctggagacagactgaggcaaatataaagtctctattgttaagaagtgcttgttgcaaaatgaccacaaccttcacaacaagacaattcaagttatacagtgttttttttcttttttggtttttttgagacagggtttctctacatagctttggagcctatcctggcactcgctctggagaccaggctggcctcgtactcacagagatctgtctgcctctgcctcctgaatgctgagattaaagacgtgcaccaccaacacctggctacagtgttttttttcaatactgaagtttgaagctaggggctttatgctacactctaccactgagctacatccccagtgtaatatgataaataacccaataaatttaactaaaatgcctgaagaaaaaacattataagcaacctagaagaaacaaacaatgtctcacgaggagctaagtcattcttatgtgctacactgagaaaggtcagtaccctgtacataaatggtctatgacacataatatcaggtgacgactatttcttgatcttacaaatgattaaacaatactgtttagaaataagaattcttatgatattatagggatatattataagaatagaaatttagcaacaaattttaaaaaatcatgagcctggtagcacaatgagaccattgtaaaaaaataactggttgtgagagcaaaaaaatacacaacagggaaggattaggaggtatggccttattggggcagctgtgtctctgggatctggctttaaggtttcaaaaaacttgtgccattcccatgcactctctgcttctgtctgtgggtctagatctgagccctcagccgctggtccagctccatgcctatcaccgtgctgctgtaaccctgccacgatggaactgcaagcctcaaataaaccctgtcttctataagtcgccttcgtcgtggtgttctgtcacagcgacagaaagtaactaagatatataaagctacagacaaaatgtttgttggtatatatgggaccatgctactggctagcttcagatctccatccctccctgtgtccaggctttctgtcaactttacagtgcctttccatgtggacaagaaagatagtcatcccctcccccgttctgctacaagcattctaccactggactacacccccaggtgtaatatgataaataatgcacgcaatacattaatttgttttgttttttaattagggtctcattgtcagtcaaactggcctaggactctttgttacagataaggctgtcctttaatttgtggcaatcctctgcctctgactcctggatgctaaaatgacaggcacatagaaccacaactggcccatgtataatattttgagcaatgggatatttgttagtattcaggcatctgtactggcctgtccttggagttttgacaggacatgccctcagctgcagccactaagcgcaccacccgggcacattcactatgttcccttttaaatgggccctgcctacctcctctcccctttctgtttctctgtctctctgtctctgtctccccccctctttctcttctgctactcctgtccccaaaggccggtctcccttctcctctccccccttttcctattcactttccccccaaaaaagcccttcctccacccaagctctattgcatggtatctttctcacaagtgctgcttttttttgtttgtttttttgcgccaccaatgcccggcacaagtgctgctttttaaaattacaactattaatatatatgattcaacctgtcatgcctggccagagagtgcccttaatcccagaattccggggcagaggccagcagatgtcatttttagggcagtatgggctaattgaactccagacaaagcctaggctgcaaaatgagatcctgtctctaagaaacaaaaatgtacatttgggggctagagagatggtcaatcgatagtgacacttgcctacaatcccaatgcttggaacgcaaaagtaagtgaacttcagtgagatcaaggctatccttttgtacatagcaagttacaggccagccagggctacacagagagacagaccctgtctcaaaacaaacaagcaagaaagatagttcaatgggtaaaggcacttgtgaaagtctgatgactcaaattctatcccagaatccagaaaaaggtagaaggagaggcaggtggtacacacctttaatcccagcacttgagagccagaggcacgtagatctctatgagttcgaggccagtctggtctacagaatgagttctagaatagccaaggctatacagagaaactgtctcaaaaaaccaaaaccaaaaacaaacaaataaacaaacaaaaaacatcagaaggagagaactgcagagttatcctctgccccccacacatgcaccatagcatgaacatatgataataataaaattaaaaactaaacaaaacctaaaatgaaacaaaaacaatctaggaaaaataggtgtgatataagaacatagaaaaaaggaaaagtaatactagaaagtaaaaataatgatagttgctactctgtctagtggtgaataatattcacagtatcacgaaatgcaaaactgaccacaagttaattgatttttttggtgctagaatttaaaagaaagagctagccatgcatgctacgtacatactaccaccaagccacatacccaacacaactactgatttaatcaaaactgaaatataagaaaatcaaacaaagatgtagcagggacattggtataaaagagctataagaaatcttcttttctcataatggaacacaattaaaaatgtctaaaatttgtcattcataaggtagctatatagttcagaaatatagaaataaataatagtaaagtattgctccaaagaagctgaactagccagaagtgatggcacaagcctgtcttaccagcacttgggaggtggaggcaggaagattaagagtttagtcatcctctgccagcctgactcaaaacaacaaccaaggctggccttgacaccttacatatcaggactggttctctttctttatttctgtcctgcttccacaaaagattttcatcagctaaacagagaagacaacagctgaactagggctacagaagacagacattctcatcattgtctgggaacttttctcaaaaccatatgtcaacagtgattctttcagtgctagatttttcaggactaatttttttcctcttggtttaaactacattttctataataatcttttattatttgtgtgtaatttttttaaaatattgtatttttattttttagtcaaattcttgctatatagcacaggctgatcttgaattccatatctgtctcctgtctccccctcccagacgtggcgattataggtatatgctaccatgtatagcttgtgctgcttaaaaggaggaaaggaaaaggaaagaaaacaagctggagcagaagtgtactcttgggggccttaccttttattgtggtcaaaatgaagaaagcaatgagggtgttgttgatagcacaggtagacttggcaacacaagacaggatcgtataaggatttaggaggtagctggggaaaacacacatagttgccattagtaaacctgaccagtggaccagagagtcctggccaccacagccatgaagttcaacttatttacaaaaaggaaggaaactccttagaaacaaattatcccaaatacaagaggataaagtgcaactgggtgatatgaataaaggcactcatcattatgctataagacatatgcaaaacagggtctcatgtagcccaagctggtcttgaactctatatagctgggaatgacactgaaatcctgatcctctagcttctacctcctgagtactgggatcacaggaatgtaccacctggcccagtagcattatctaacttttgcagatgaggaaactgagattcagtgattaaataacttgcccaagttcttacaagctactaaatatattcaaaaatcaggtcttcctggttctaaagccaacattctttctactaagccctttttatagtcaagcagtatcccatgacccagactcatgaacagacaaagtttcctctaaattctacaagggagctggcacagaacttcacagatcttgatctcccattaggagagtgttaaactggagtcctttccccctaaagtaggaaagaatggaatcagaaaatgaatccgaagtgctttgagtaggaaagtcttacttggtcaaatggattctttttatttatttctgtcctgcttgtacaaaagatttgcaccagctaaaatgacaacaagtaacaaaagtagtaataaagtaaaacgagtcataatcaagaccagaggaaatacctaagaagaaaaggtaaaggcaaaaccaggaaaaccaaagaaccagagcagtacaataaataccagcctcagacagactacagctgcacagtaattagcctcagacagactacagatgtacagtaccagcctcagacagactacagctgcacagtaattagcctcagacagactacagatgtacagtaccagcctcagacagactacagctgcacaataataaccagcctcagacaggtcaacagctgaacagtaaccagcccatataggctacagctttacaataaccagcttcagacatggctgactttcctggcagacaaagccagttacataattctgattgtcgaaaggaagaaacacaccagcttctcagtaaaagattataataattattcacaaataaagaccttaaatctaatcccacctcctaggaatgtaagattagtagttctaaaaccaaaggcctagaaactctttcgggcttggtgaggtttttcttatgttttgtttttcccagcaatcagatagacttgttacacaacctttaaagaaatggctgctgctatgatgaaactaccctcaggggacacaagagtccataaggattcattatgttgctaaacctttggtctattaaagtatttcccatcaaatctctgaaatatgtagttgagaagtgataaaccaatattatctcacaggagaaaaaaacagaaaaccatttctaaatagtgggtgacattgaagaagcagctgcctagacatctacctggaacactggagatttatacacagggcaaaggctcctgaagacccccgccccaggacagactctaaggtgacctaaactggcttcaaactcgccatgcaggtgaagctgaccttgaacttttgttcttcctgccacccctccccaagtggtggggttaaggataagtatcaccccacccagtttcttgggtactggggaccaaacccagggccttgtatgtgctatgcaagcactctgccaaccaagcaccctccacagccccttgtttcctgatatggaatacttctacatagcacagatcagcttcaaactcatcaatcctcctgctttaggcctcctgaggctgggacaccaagcttctaattctaaaaaattctatggtcatgtttttccatgagaaattttatgttttgttcaatatgtgtacctagaaactagcatgttattaaaatctgatgactactagttgattaaataattcacttcacctatctcagaaacacaaatgggaatgatctgagaggatcacactcactggcagtaccaattactcctagagaattctttcttaaagcatcggctggtatcactcttccaagctggtcacctagcccagatgagaattttacttcagttttctaaattacaaacagagaactaaatcatatgaggaatatagaagctatatgaaacaacagccacataaagaccagaattttatacaggacatcaggaatgaagaactaccatcttttagaaacagcaattaaagcaggttggagcccagatcagcactgagtcagaaagcctttgtaaagggtttgattgtgcatgtccctgtgtgagtctttgtctccacagacacagaatggctctgtgtcttttgctggccaaaactccagttgtgcaagagaactacagcaaatacttgatgactaagaccacaaatctctaaaactacaacaacatgagaaagtctcatcagattttccttgcatttgttggctctgagctctgatttgtaagggaatacttacaacagggccactttcagagggatgtatcgcatttccataggggttcggatgagttcggccacatctggagcatactggtccagttctaggaggagtttctgctttttaaactagagatgggggagggtacacagacacacaaaacagatgatttgccatggtttttagaatgaagacaaaaatctttgccctggcccacacaccactgtctgtgctcccctacttctccagggtactctcaaaattgctcctccaccctacacccactgagatccagcacatgaacagacaaagctcctcatgctcccagaactctgcatttaaccccgattctcccctagttaatgccccaacagccttgagagttcacctaagtcctccctttcttgaaaggcacacagtcctttagctgccctactgcccattctttcactagtgctcacagctctaagttttgccttctttgtgaaattaacacctggctcctccctagagagtaagttccacaagggtgtgagttactttacttgctctctgtgtatgcctaacacttagcactgtggacaaaaaattagatgaacatatggtgaggccacttcttagtcatcccaagaggctacatcactggtggccggacttcaaagttctatcagcaaagtatgttgaaacagtttcaatgatctggatgcatgttatctcaggttcccctcctcattcttctgtttcaaaggtttgtttgcttttcttttatacttccatagaagaggtgtgaaatagttaaaaataaaggagactggtgtggttggggagctaaagatttaagatgccgtcataccggggtggaaagctctttactttctcttatgcaccccaacaaattcatgggcacgagttctaaaagggaaacatcatcacagcaaaggacagactaggttaatgacactttggccaagatcaactgactaccaacagttagctttcacattccacaggctaacagcagatagggtaggtgtgaagtcccttcagcaccagttttccaggatgctgtgcagatggcagggatagactctcaagtcctcccaagactaaatgtttgcagactataaagcaggatccttgtaaaatggagactttttaaaaataattttatgatactttgatcataatcatctcccattgctctcttatctacttctcactcctgctgtactcttggttccaacaagtccctctttattttcttttattttatgtttatgggtgttttgctggcatgtgtctgtgcaccatgagtacctggtgccaggaaggccagaagagggctttggatcccctggaactagagttttgaacagttgtgagctgtcaggtgggtgttgggaatacaacctgagtcctctggaagaccaatcagtgctctgagctctctatgttcgaatgcgcacacgtgcttgcgcgcgtgcgtgcgtgcgtgcgtgtgtgtgtgtgtgtgtgtgtgtgtgtgtgtgtatgatagagacagacagacagagatgggggagggagacagagacacagagagaccagttgggggggacagttaacagaaatagagagacaaagaccaactgagtttaattaggtttgcttgcatgagcatgggaaggaggctttatactggagcatagacaacttaccagtggtaacactactgaagaaaatgactctccctcctttacaaagtaaagccttttaggaatacatgtgctgacattctatctaaatcaatagtggtatggtgtctaggtgtggtggcatacacctgtaattccagcacccaaggcagaggaaagatcatgagttaaccaggactacataatcagttctagaacagtctgaactacatatggcgactcagtctcaaaaaataaacagggtcagcaaaaggactcataaagtaaaggatcttgccatcaaaccaaatgacctgagttccatccctgagatcaacatggtggaagaagaggatcaactccggaaagttttactctacatgtgtagcagagcaagtgtagacgcacaataaataaataaataaataaataaataaataaataaataaataacgaaatagcaaaggcttggagtgtacctcagtagtagactgcctcacatacataaggctctgggatttatctgggttttaaacactagaaaaagaaaagaaaaaaagaacagtatatgacgtgatagtagcactaagagctgctactttcagcattcatgtgggtgtgaaacaaacccctaatccagtactcagaagactgactcagtggccagggtggtggtggcgcacgcctttaatcccagcactcgggaggcagaggcagacggatctctgtgagttcaaggccagcctggtctccagagcaagtgccagaataggttccaaagttacaaagagaaaccctgtctccaaaaaccaaaaaaaaaaaattatttattttatttgaggtgtgagtgtgagtgtgtgtgtgtgtgtgtgtgtgtgtgtgtgtggtgcacatgtcagaggataactttcaggaatcatttctcttcttccaccatgttggccctggagacagaactcagatcatcaggcattgctggcaagtgcttttatcccatgagccatctcaccagccccacctaactatttaaaaatagttggatctttaagtacatgacttttgattcatggccataataagcacattaccaaatcccaccagccttgtcctacccactatgacttaccacaactttattgaagtcctgaattgcaaaatacagggcaatagcagtgagggcatctgttatctgtcaagagaaagagaagtaacagaaagagaagtaatgggagtaataaaaagtacagttagtacatggtactggaatactgccaggatggaacagaattgacttcccaccaccaaactcacagtcggtcaaggcctactcagggaggtatgacagaaaaatctagattatgatccattcaatcaggtggcccatatctctagaccagcaagttaaatgaaaataagccaggccttgtggttaacacctgtaacaccaggacactggagaactcccatgagttcaagatcagccttgatcacatagtgagatcttgtcaaagctaatgggaataatatccaccatctgtaggcttcaggtatgcaagcacctcacacatggtaagtcctcaacaattagccattacaattaagaaagatttcagggtttcttaagatatccagattttcaactctgtggattatgtttcaagctgctcttctatcaaaacttgccctgtcatctcaatcttcaattctcgtccttgaaagcctcttcagctccctcagaatcccttggcagaatgcttaggaaactcaggatgccctccaaactggcatagttagagccaaccacagactctcagggttagaaaattgaagactacatagtccaataaaccaaaaaatgagaaagaagaactggttgcaagaccccgcatgttcctcatactccacaataccacgccaaagccagactccaagctaaagatactgtcctggcttttattttttgagaagttccagttcctgtttttcctttcctttcctttcttatagacagggtctcaaaatatgcccctggttggcctggaatctgctatgcagaccaggctagcctcaaattcacaaagatccatccacctgcctctgcctcccaggcgctagaataaaggtatgagctcacccagctccttagtttcttaaaaacaaactgtaaaattaaaagcatatacatatattgatttttctctggaaagatacttaccataaataccaattctgcataatcgattaggaaatgaaagaggtatattattaatggagtctgtaggagaaaaacaaagatgaaaaaaattaagttaaaccttaatacaaattatccatttccaagttggggacggggaaaacttattcagctaaaaaatccaatccttcctgcaacagttatcctgtactcattgaacaagttatcatcctatgtcacatggtatcactgaaactatcagttgaacacagtagaggaaataacaaagcctgatattatctagattatctgcctggcatgtttggcttgagggttcatccctgtagtagatactcaggaggttgaggtgagaaaacagattgaacctagaagttcaaggccatttgaaaaaataaacaagggcagagggtgtaactcagtttataggatgtttgcttaggatgcatgaagccccggggcttgtcttcagcactccaaaaaatcaggtgtatgcttataatctcaggacttgaagtgcaggggaaagaaagggaatcataaactcagagtgatcctggctatacaagttccatgctagcctaggctatgagagatcttgtctcaaaaataagtaaataaataaaaatgggagggggcactccatagaggaacaagattgttgcatgaacaaactaggattttttccttcctctattctctgataagtttgtacaagaatgttaattattcctcagagacctggggagaaacccacatggtgatacctgccgaaatcccagcacttaggctgaagatggaaagttcaagatcaatctgggttattatactgtagaatcctgtctcgagggagaaataaagtgtttgagaaaattcacttggtataaaattaatattggcctgaggttttatttatttattcatttggtttttggtggtgttggagtggcagtggtagaagggtggctgtctgttgttttttcttggtgctaaggatcaaactgggtctttgaacatagtacatacatgctacatcattaagatacatcctcaatttctctatcgctgagatacatttctttaaaaagaacatacaattatttttctatgctttgtttttaatttggtttggttttggacctttgtgatggagggttatgttgccaaggcaggcctcaaactcactatgtagtcaagatgaccttgaatttctgagcatggtgccaccatcttcctagtgctaggattacaagctctggttttaccttttctgctttgttttgttttcttgagacaggatctcagatatcacaggctgaccaagaacttggtatgtagccaaggatgacctctgaacttctgaccttctcacctccacctcctgagttacaggcatgtagtaccacaacaggtttatgagatgcttgggattaaggccaggatttcatgtaaaataagcaactgaaccaacagagctaaatcaccagccctagtctcactattattttaagatttaattttactatttttattgtgtgtgtatgtgtgcctgcatgctaatgccagaggagggcaggtgagggcatcagatccctgggagctgggtttacagcctgacagaacgataatactcaaacctgggtctcctgtaagaatcatagatgcccttaaccactaagccatctctccaggccctgagtctcactctgcaaactgtactcttgggttctaattattctggtacttcccaatgccttcaaacaccttttgggatttactctacttttctacttgtccttgccaacatacctagcccactactgtaagctaactcaccagtccatcagaatcagaaaggaagtgcataattcggttttggtgtagtggctcacaagcatctgtcccaccatttcctaactacatgtaaaaaataggttttataacactataaaaggactaaggatgagggcagtggtggtgcacgcctttagtcccagcgctcgggaggaagaggcaggtggatcactgtgagttcaagaccagcctggtctacaagtgctagttccaggacagcctccaaagccctgtctcaaataaaataaaataaaataaaataaaataaaataaaataatgtagttaaacttgtccacatacacaaaaacctaagtggaaactccattaccaaccccctcaaatatactctgagccaggaatagtgaatcacatctatgatcacagcacttgagaaactgagaccagtccatgttacatagtaagttctaggacagcctgagctatgtaagaggtcctgtttcaaacaaacaaacaaacaaacaaacaaaaaaacaggaggaggacaaaactgtaaagatcactgacaggctttttagtaaataagaacaagttacagtagaaagaaggaaaacttagagttgggatttggatttaagtccatagtttttgtagcaagttgtaactttgaggccttcaggcaagttgttttcctctctgggcattagttttctctaatataaactgggggacatgatctttgtcggaggctgtagagacagctcagcagttaaagagcactggctactcttcagaagaccaagagtcaattcccaggactcatacagacacaaatgcagacaaaacacctacacacaaaacttaaaacttaaataaatcattaagacaatctatctcacagggctctagggaagattaaatgcagttatgtgtatgaagtaattactacaatgcctagcataagctaaatcttagcatatggcttcttgtgatcaacttttgtttgtttgtttgttttttgagacaaggtttctcagtagctttggagcctgtcctggaattcattctgtagaccaggctggcctggaactcacagagatctacctgcctctggtgatcaagtttttaattctttttttaaaaaacaggcatcaattgtctctttccaagttttaaaaggattactgtctactgatggattttattatttgagtatctttgttatcatatatatatatatatatatatagagagagagagagagagagagagatgcacacatatatctgatatttatatttcaaataacctcctttcaaaatttcttgatgcttcagacagtttagaaaggcccaaacaaggaaaacactgtaacagttctcaagaagcctatggctagcctctacagtgagctagcatgtgtgtggcagtgtggttatactggaataaagaagcacatgttgaatataatctatcttcatgctgtctattgatttgagtgaccataaattttttcctaagtactactttagtgctatgttacatatttgacagctaacatttttcactttcatcaatttcaaaattactttctaatttcccttatgatttcttgattcctaggttatagttaccaaagatttgggggattttccacatatcttctgatgttaactctctatttgatccttctgtagtcagcaaaaatatttaaatcgttaagtgacttaaatatattgagccttgcccagctacatagaggctatgttgtcttggaattatatgattgctgaggtaagagtaacagctgctaacagacatttgcttataaatgctgctggattgacccaaactatatattttgaacatgcttttgacttcaaaatttaagactaaggataggttactttggaaaagaagttctgtttttgtttccacagaaaatgataagctgtggattccttctagactaacatggtttgatcaagcaagaccccctgaagcagtggcccaggtgatccaacatccaaaacagctgagatgatgtagcctcagactactacagccaggatttgaacaggtttctgggttttctcaggattctcatggtattgacagcgcctccaaacagcaggaagcaatttggagagaacacacccaaattcctaaatattgtttataaatgtttgttttcatttaaatggggttggttacaaatggttaaagatcacaaccaatctctttctaaagaaagaaaagggaatatgatatagaaatgaatactttgtattggaatggatttcagtttattgatataaatttaaggtcaattttgttatatatgtatttctccccttgtttaggtattgtgtttacacagaccttttaaacatgcaatatataattaaatacagactatagatagtcacctataataatcaaaacttatagttatgttacttaggttttctagatatacatagatatatttcaaatggatagatattcttcaaaccattcaaagacctacagaatatggtatttaaaatggtttagggtttttcttgacagtgagacacagctgctcctggcaacaccaattacttcagaaaggaggatgtaatacagagttgctttcaatatggttaagattagccatttgggcaagaaactgctcttgcctggactgcttgacaatatgctgtataaactggacatacaggacccacaggaaagtgactactgaatttgccaaaacaagatgagacagtcctgcagggttcctgtttcatggaaaagtctgccagacattttgcaggacacagagaaaaaggactgatagaatgccaaaacaggcagacagtttaaaacttcttgattcattgagaagtctgccagacacactatggcctatgggctgaagatggatgctccaatgttacagagaaactttggatgacggtccagacaacaagatttctctgtcattactagagtttatgtattatccttctgttgtctttgatgaagttgaagacagatagttatggttatggttttccttagttataatataagttatatataaaaccttagactcacaaagataagatagatgatagaatattttctttaaattttaccaaatgttaatggactaaattttgttaactataattcttacttgataactgttttgttatatataattttaccatgttaaagttaaaacccttctttttatttagacagaaaagaggagatgatgggggatgttcttctgtatatatgtttcttttattggttgattaataaaatgctgtttggccaatagccaatagaggcaggaagataagcaggccaggagacaagaattatgggaaaggtaggcagagaggcacattctctggtaacccaagaccacatgggaatacacagacttatagaaatggttaataattaagacagagctatgataagaagccctagccatcagccaacagttttataattaatatagtatccttgtgttcctttggggactgaggcagctgtgggtccaggctggaagaaactccagcaagaaattacatgccaacttagcatacaactatttatggactgagagctgcttaaagtttccattaaaaataatagtttctcttcccccaataatgagattgatgactaccttatatgccatcctagaaccttcatccagggactgatgtaagcagaggcagacacccacagctaaacactgaactgaactcctggaacccaattgcaaagaatgaagagtgaagagcaaagaggccaagactgagctgctgaaacccacagaaacagctgacgtgaacaaggggtgctcatggactccagactgatggctgggaggccagcatgagactgacccagagcccctgaacataggtgtcagtgaggaggcctcagcaatctatggggcctctggtagtagatcagtatttatccctggcatactaatggactttgggagctcattccacgtggagggatgctctgtcagcctggacacatgggggagggcctaggccctgctccgatgatgtcagactttggggaatcccccatggagggcctcactctcccaggggagtggagggggggatggggtagggagttggtgtggggcaggggaggaggagagggtgagggagctgggattaacatatgaagcaggcttatttctaatttaaatgaaaaatgtatataaaataataatatgtacatattattattattatatatacgtctcatatattccaccaagccagaaagatggcatagcagggaactgcacttgctgcataagcctaacaagctgaattagatccctagaatccacagaaagctggttgcatctagaatctcagcactcctgacaggagacacacccagctaggcattgccggctaggccagagtacagagaccctacctcaataatgtgagaaaactgacactgaaaattgtaaattgtcgtgccccccccttctcctttctaaaatcctaacctggatcattttccctgtaattgtgaaacatctttcttatgcaaaggatgtctacaaaagggctattcctatcaaacaaagctcaggctttggtatccatgactataaactactctcaatgccagaaaagaaaatataacacttacttcatgaaatactgctccagaatatggagacactcccaaatccaacagtgaaaggccttcaaccactgaaaaggaagaaatacaagttcacaaagatgttagagacaatagcaaatggtcataaactaaaatgtcagatattcctaggaccaaagaatgcttgagtttgtctaatccctttacaatcggtcaaccaagtggttgtaggtcttgatttgaaaaaatttcaagtttgtacatatgcatgaaattctcaaagaactcccccccccaacacacacacaattatcaagaatggagaattcttccatacaaagcagttctttacatcatgagctatgttcattatgagaaagttttataataaactataaccttctgagattggagaaatggcttggcaattaagagtacatactactcttggttctcagttcaattcccgacacctgcatcagctgctcacaactgccagtagctccagttctgaggaacccatcaccctcttctggcctctacaatcagcatgcacatacagatctacacagatacacataacttaaaataaaactaagtataatttttttttttttttgggtttttcaagacagtttctctgtggctttggaagctgtcctggaactagctcttgtagaccaggctggcctcaaacttacagagatccgcctgcctctgcttcccgagtgctggaattaaaggcgtgcgccaccaccgcctggcttaagtacaatttttaaaactataaacttctaaacatctttgtaacatccgtcagctctaaagcatttgttttatgtgtgttctatcctatccaaagcacaattaacaaaccagcagcaggtttttaaaaatgctgtccaggttagtggaacaagcactctctgtgcagtctgtttcagggacatttgtgtcatttttctacagaataacatgtaccttttagctttgtgcctttaatcctaaccttccaggagatttgagaggaagagggggattgtttttttggatggcgggggaggggctggtaacggttgtttggccaggtttgtgttttgtggcaaagtatctagacgtaaaggggattgactccaagcttgcaacccccctgtcttagccccagccccaagcgttagaattataggaggcagctatcaagcccagccagggtgatatattttgtttgtttttcaggatctgtagttcagtctggcctcaaatttcctgtgcagccaagaagcaccttaaactcttcaactctcctgcctccacctcctaagttctaggattacaggcatacaccaccatgtccagctgaaaatgtttgttttttggtttgagggggtttgggcttggttggtttggtactatgggctgaacttgggaacttgtgcatgataggcaataactccagggctgagctctatcacacacatgtttttttatacaaggtctcactatgtagctctagctgactcatgactcactacatacaccaggctggccttgaactcagagatccacttgcctctgcctccccaatgctggcattaggcacatacaaccaagcctggccccaaatgataattctttctttctttctttctttctttttttctttctttcttttctttcctttcctttcccctcctcctcctctttgtttttagagacagggtttctctgtataacagccctagttgtcctggaactaacactatagaccagactggccttgaactcagagatccacctgcctctgcctcccaaattatgggattaaaggagtgcaccaccaccacctggcttaccaaatggtaattctttttttgttgttgttgttgttgttttttttttctttcttctttttggtttttttgagacagggtttctctgtgtagctttggagcctattctggcactcgctctgaagcccaggctgacctcgaactcacagagatccacctgcctctgcctcctgagtgctgggattaaaggcatgcaccaccaacacccgcctcccaaatggtaattcttaaagtagattattttaggaaataaatgatcaagtgcctaatacaatatattcagtatagcactcagagtaataatgttttatcttctgtataggtgctttgctgtgtgtgtctgtgcaccatatatgtgcccaattctgaggaggcatcagatcctctggaactgagttacagatagttgtgagccaagaagcaggtgccgggaatagaacttgggtcttctggaagagcaagtagtgctcttcaccgatgagccatctctccagcctcacttaataaaaacttcaaaatagccgggcattggtggcacacgcctttaatcccagcactcaggaggcagaggcaagcggatctctgtgagttcgaggccaacctggtctacagatggagttccaggacaggctccaaaacaatacagagaaaccctgtctcaaaaaaaaaatttttttcaaaataatcccaacattgattaatggagatttatttaaataatatatgtatctactagtatactaaaatatacatatatatatatatatacattgatatattaagcattaaaattatattgaatgctcagtgtcaagtgcaggaaggctgggcatgcggtgcagcagggcaacatgcaaagcatgcaggaggatctgagttcaacatcaggacgaaaagggttaaaaatgaagaatggaagatggaacagaaagtcatccgttgactgacccacagaatggttctaaaggcaaacgtcgttagtggatgctaaagttagtgggcaaagtatgaaagagaaagtatttgtaaggggaaaaataataatttcacgtagaccttacattccctgctttaatcgggagatacattaaaacatcatcaatatgttaattatattaattttcaagtatctcatgattcactgatgtagggataggaacatttctgtggtcctcatgccaacaatgtggtataataacaaaaacaaactaacaaaaaaactcataccctccacataatcatggtaaaacatcaggcaatcaaaaatgacaggcaagcagggaacgcctttaatcccagcactcgggaggcagaggcaggcagatctctgtgagttcgagaccagcctagtctacaagagcaagttccaggacagcctccaaagccacagagaaaccctgtctccaaaaaccaatagatagatagatagatagatagatagatagatagatagatagatagaatgacaggcaaataattgcccagtactcttaaaagattaaatcaaaggaagtatcccagattggcagtcactaaggagacatagccagtaaatgcaacatgacgtcatggattgaacattaggccagaaactagataacaaaagggaagcagtacaatcctaataaggtatatatactaacatcactgactgactgaagccactatattacagtaatattgggtaaagtgtaaatagaaactgtatttttgcacgtgcgagtgcgcacgcgtgtgtgcgttcatgtacacatgtgcttgggagtacccatggagaccagaagaggttatcatatcccttcaagctacagttactggtatttataaacaacctgacatagatgcttggatccaaactcagaaagaccagtaagttctctctctctctctctctctctctctctctctctctctctcttcctctctcttctcttctcccccctctcgtgtgtgtgtgtgtgtgtgtgtgtgtgtgtgtgtattttgggttttttttgtttttttttaatttttttgagatagggtttctctgtgtaggcctctcctggaactcactctgtagaccaggtcggtcttgaagtcacagagatctgcctgcctctgcctctcaagtgtttgtattaaaggtgtgcatggtcaccaccacctggcttacttaataagtacttttaactgctgaaccatctctccagcccctttgcaactcttttgaaaattgaaatatgtcagggttggcaaaatggctcagttggctaggtgatgattgccaagactgatgacctgagtttgaccatcagacctaaagtggaagaaccatctctctcagccaggtggtggtggcgcacgcctttaatcccagcactcaggaggcagaggcaggctgatctctatgaggtcagggctagcctggtctacagagcaagttctaggacagccaaagttagacagagaagccctgtcttgaaaaaccaaaaaaaccaaaaccaaaaaaaactatagatctacatttatagacggaaacctgtccacaaaatgccaagagaaaagcaggtagtaatatgcttttaacatattttaacacaattttaatttaatttttaaagaaattttattaacatcaaatacacaaaaagaatgggctttattatgacattttatacatgtgataccagcactcggagacagaagcaagaaaatctcaagtttaaggctagcctgggctacattgtaagactttctcaaaataaataagaaagggaggggggaagagacaaaaaaaaagaaatgcctggaaaaataaatattgaaaggccttaaactatattcaacctaaagaaggaaactatagtggccagcattttttcccccaagacaggatttctctgtgtagccctggctgtcctagaactcactctatagaccaggctggcctataactcagaaatccaactgcctctgcctcctgagtgctgggattaaagatgtgtgccaccaccacacagcatcatttttttaaaggctgattgtgcaaaacaattttaaccagggctagcaagacaccttaatcaggtaaaggttcttgttgccaagctggatgagttgagctcaatcctaggaacccacatggtataagaaaaagaccaactcccacaatttgtcttcttaactctacaagcatatgtatgtgcacgtacacatgtgcagacatacagagtaaatacatacataaatatttatagagacaactgtaactgggaccagaaagaaaatcccttaagaagcagcatagaggtagctctgtaagacagctagctattaatctctcactaacagctctactggagacccaaggaggggattcattagcccacttcacaagacttcccccggcctcagccaaaggcatctgagcacagcagtaaaagcagcactttggagatccaacagtgcaaggctgccttgaaacatcaggccccacactcccatttaacccacagagaggttctcaggaagcagctagagggcaggctccatgcctctctctcagagaaacttttgctagacgctgtgcatcagtaaacttgtttgagtattctctggctctggtatctggtgatatatgacatccagtataacagatttcatgatgtagagatattcaatggaatacactgagctttatgattaactccttcattattatatcggtgcacatgtatgaaaactttcctagggcctacagtgtgcatttcccatccaagacaaaagagtaccaaaattctcttcagactctatagatgattcattcaatgtttaaaaactaatcaggctaaacatggtggcttacgcctgtaatcctagcactcaggaggattactacaagttatagggtgtctggtctatttatgaagttccagtccatcttgggctacagtgagacactgaatcaaaaataaaatagcaacaaaggaatgataacaccactcgggaatctgaggcaggaggatctctatgagttcaagtcagcttggtctaaaaagtgagttctaggacagcctggtctacacagtgaaaccccatctcaaaacaccaaaaccacaaaaaaaaaaaaaaaaaaaaaaaaaaaaaaaaacaaaaagggggaaagaacaaaaaggatgaaagttgaaatactttcacatacattatacacttgtaatccttacactcaggaggcagagacattgggatcttgagttcaaggctagcctggaaaaagaaatacttttataaacatgcagttcccacttactcctacttttccaaatgttttatttactcgtgtgtgtgtgtgtgtgtgtgtgtgtgtgtgtgtgtgtgtgtggtgtaggtcagaggacaatctgaaggagtcagttctctcctcccagcttgaacaaccccaggctgtcagacttggtccactgagacaccttgagagcccctacttattctttcaaaggagctttcctgctccttcccttccaccatcctgctgaggaaaagccagatatgtcatggccacatgagccgtaggcacagccacacagcatcggtaagtatggaggcaatcagaatcaactcgacaaacatcaaccagatgacctgggagggctgggatgcggcactggcacttaaagaaccagagctcctgcccaactgtcaacctcagtaactctagacactggccagtgagcagacatgggtaaatgctgcccaaattgagctgccatggtatgactgggcttccacatatactgacatggtatgactgggcttccacaaagttctagagaagggctccttaagcagcctgccatcctgaaggccaaatgcttcaaaggagccacctgtgccctgctggcttgacaccacacaaggagctagctccattaggcactaacaaacttaaaaagtaaaagttaagatgaacaagaacattataagacctaaaaaatattaagtgtggatgcctgtccctgtttgaaacaaccaccaaagaattaatcaaactgccagattctaacacatatgtataatgtgccaatactataaggctagaaaatgtttagttgttttttttcttttagtgtctcatgtagcttcagctggctaaaagaagtttaacaaaagactgaaaagaaaaagtaaaaactcagaacaaggggtatagttcagtggtagaacacttgtctaagatgagcaagtacctaggtctgaccacacacacacacacacacaaaaaccctacctatccatataacacaatactccacacataaatagttttgaactataactctaaatctttgttgttaagcttggatttgttttttttttaacattcattggggggcatatatttggaggtcagatgacaactatggagtcagttcttctccctctactctgtaagtattggggctaaaactcagattattaggcatgacagcaagcaaccacacctgctgagctatcatgtcagcccagttgtttctttgctttatttattttaatgtgtgtatcatatgaatgtatgtgtaacaggaccccagatcttaataggcatccagaccttagcacaactgactctatgatggcagtaccattcagactataaaactcagtacatagacagtattattttactacctgccaaaatgaaaacaaaggcctaatccatcaaagtctatagttctgggaaagtctctaaatatactaaccttgcttttttacttcttagtttcaattctggttaactgttcttgttaatccagaatgcggtttttaggcttacaagctcaccctaaggaaggctagggtctatcctgggatccttaacacccagtatagtcaccagctaaacatatgccaagcaaactggccctcaagattccagagattctctgatctatgcttcccatcacccagtaagattaccagaattgtatatgcttacacaatgcatgttgtagaatattattttaagacatgttacattcatttatgctgtggaacatttgtttaatgatacattcttttatgttgcatttgtttaactctatgaagattgttactttgcctgtctaaaacacctgattagtctaataaagagctgaacagccaatagtgaggcaggagaaaggataggcggggctggaaggcagaaagaataaacagaaggaaaaaaagaaggatcgggaagcaagatgggttaagaagtgagaaaagggggccaatcacccagccagccaccaagtaagattgaaaataagattacggaagtaagaaaaggaaaaagcccagaggcaaaatgtaaatgggataatttaagaaaagctggctttaaacaagccaagctaaggccaggcattcatgagtaataagttcccatgtgtattaatttgggagctgggtggtgggctcccaaaagagtcaagcagtaaaaaacaaccaactacactatgcatgcagcttttacctggattataggatcaggtctttgcttgcatggcaagcacttgtactcaccaagccatttccctagccctaggtttttgttgttgtttggttgttttgttttggtttggtttttttgtggtggcagtggtagttttgttttttgtttggattttggtttttgagacagggtttctctgtgggatggtcctggctgtcctggaacttgatttgtagaccaagctggcctcccaggtactgggattaaaggtttgcaccaccactgcctggtttgttcttgtttttttaagaaaggtctcattctgtagctcaggctggactacaactggtggcctcttgcctcagctttcatgtgttagactgtagatctgagacatcattatcatctacctatgaaagaacaaataacaccctaacttaaaacccatcagttaggctgcaaaccagcccaattggtagagggcttacctagtatgcaagaaatccagggttcaatgtcaagcaccacataaaaccaaacctgtaatcctagcacctgggagatggtggtaagcaggtcagaacctcaaagtaatcctcaattacacgagttccaagccagcctagaacacatgagactcactctcaaaacaacagcttttccttgtggtctctgctttagtttctgcctcaggctcctacctcagctttccctgataatggattgtaacctgtaaaccaaataactctttccccaccaagtcagctttggtcagtattttatcacacagcagaaaggagatcagtacatcttttctcaaaaattaggtggaacacaatcaaggaagacacctacagcaaatctggtctacacacacctgcacatacattgtgtacatacacagtgtctaaataaataagccatattacagtcaaccaaagtctatgaggatactgggccctttatccaaagagctggtgactcaaaaatctcaaaatgtcatgtaaaaccaaaatggttcccactttactttcattttgtttctctgtgtcgccttagatgtcctaaaacttgctttgtagaccagggtgacctcaaactcaagagatccacctgactctgcctcccaagtgctgggaataagggcatgcaccaccacatctggccctatttcatgatttttaaatgcataacatttagagtttaatataatcgcctgcttgtttctttggttttgagacaacatcttattctatagcccaagctggtctggaactcactatatagcccattctgccctcgaactcctaatgaatcccctacctcagtctctaaatgctagaattaccacaatgagacaccatgcctggcacaattacctgcttttaaatccaccccacttgacttgtaaatataagtgacagatactatatcctctctttaaaatgaactagcaactaccctttgttaacacaatccaaatgctttatcactactgtgaaagaaaactgacctccaaagagagtggcactattaggtgtggccttgtaggaggaaatgcatcactgtgggggtgggctctgaggtttcctttgcacaagccactcccagtaacacagtctacttcctgctgcctgcatatctccttgtaccagctccttctccagcatcgtgtctgcctgcacagcaccattatagttatggactgaacctctgaaactgtaagctgccacctcaattaaatgttttccttggtaagatctgctgtggtcatggtgtctcttcacagcaacagaaaccctaactaagacaactaccaaatctctctagtcttgatactgaccctaagctgtggaaatcaacctctggatgtcacactactaacatgtatgccacagacttattgccctatcatttctgactcacatactcagtcaactcagtcagtgtcaccacagttctagtacctaaacccaagttctcagaaatgatgttttggctttactgagctaagcttcaacatggattatctcatttagtgtcctgtttcacagacaagaagtcacaaaggaagtaaatggcagagaaacactcaaatccttcctacgattctagaaatcatatacaatgctgactcatctttaaattcttctaccttttaccctgtaaatcacagagctcatgctttcatttcttccccatcattcaacagtaactacacacctgttctatgccaggcaccaaggaatttaggcataaatcaaatagttcttctagaagctcataatactacaggaagaccagatctaaacgaataattgttatataaggtgagaatttgtggtgatatattgtttatgatttaataaagccactggaaatcaaaatacaaagctatccacagccatagagccaggcagtggtgatatacacctttaatcctaacagtcatactagctagccatagaggccaggcagtgatgatacacacctttaatcccaggactcaggagacagaggtagatggatcttagtgagtccaagaccaccctggactatacaaaagtatatcagtctaaaagaataataaagctcatacctttaatccccgcactagggaggtataaaaggaagaagcaaagggtctcgtgtgggatttagtttccagatggagagcattcattgcactctgaggattcctggagacaggattgccatttcagctgggtagaggtaaaagctactggcttggctgctttgcttttctggtctttagcttgaactccaatatctgtctctgggtttttattaatcatgttataagaaatactgtttgccgggcgttggtggcgcacgcctataatcccagcactctggaggcagaggcaggtggatctctgtgagttcgagaccagcgtggtctacaagagctagttccaggacagcctccaaagccacagagaaaccctgtctcgaaaaaaaaaaaaaaaaatactgtttgatttttgctttttagacacagtctcactgtgtagctctgctgaccttgaattctataaggagcttacattggtttcaaacttgggatgtctctgtctcagactcctaggtgctgggattacagacacagccaccatgtccagttcatagaaatagtcttaatacaggcatgtatgaggttctgagattgtagaggaagaataaatgaaaaaaaagggggggggttcatgacagcaagtgaaatcaagacactggtattaaagtttgagaataaagttagatgtggtgggccacacctatagtcccagcaattaaaggcccaggagagatcctgtttcaaaaccaaacaataagagacgtgtaaggctacaaaggactcttctaaggtgctggtatttttgatctggattatccatgtgtatgtggttcataaaaattcactaagctctgtccacacttacatgtgctttatatgtataatgtacttcagttcttgttttgtttaaagacctaaacttgatctggaaagatggttcagtgggtaagggcacttgatatgcaagcaagaaaatctgaattcaaatcccccacacccacgtcaaacaaacaaaaaaaaggtcatagtcacagatgcctataactccagcattgaaaggatggggacaggaagaaacccggagctcctggtcatacagcccagtggaaaaagcttcagagagaccctgtctcagagaattaagggtagaatgatacagaaagacatccaacatcctcctttagcttctgaacatatgccacaagcacatacaacccctccccccacacacaagtaataatgctaaatttttttttttttaattaaactgtagccctgacataacccacagatcttctcaactctggatatttcaaatcctcaggtatttcttgatcctctttgccttctgcaacctggaactcccccctttccttatcttttccaaactctagtccttcgttagtccattctggaaaatgaaataccgtttactcagggtcaggaaattattacaaaaacttcttcgtctcctctactggcctgtgactccttcagcccaatgtctgtgtcttgttggagggaataatatgcaataaggtttgatgaaaaacacatgcacacatatattaacaagtcagaaactaagaaaaacttcacgagagtctcagattgggcagaaatgacttcagtacagatacctttcttgcaaaggggctggttcccttggccctccttaccccctccactatcggtggaacaccgcctgcaatcccgctgccaaaccctacgactccacaggaaagaatgcacacagcaccttcggatgtccatccttccgcggatcccgctccccgagtcgggatggtgggacacgccccctcggatacccacccctcgggtagcggggctcacgctccacaccttctctacaccccgtcctccgcaccatagctccgccctcagctcgcggaggaccccaggcgcgggtcggactcctcagaaccgcgcacttgtgcccgctgcctcagcctccgattcaattcactgaggctgggcggtgcagaccggcctactccagccggcggcctcacctctcttccaagagctcagtggggacaccacctcaaccctctcggaaatgaactcagccagactggagcgaaacaaggccgccctcacggtcacggccaccacaagcacaagggccaagggagccgccatgataactgaggcgggcacacaggcggggagggcaaaaggcaatgcggaagagcctcaagacctgcgcgccacactgtagtacctcggtcgagcgagtgcggctactgctgccggagcccgccggccagaagactaccactcccagaaagtcttgcggcagggcgacggaaagcgggatatgtcaaacttgtagcaaaggtttggactacgcctccgctcacccaagagaagtgaaaaatattggactcatttttactgagaacgtgagcttaacgttgaagaaataatttcactcttgtgcatatttttaatgttaaaatgtttacctttatattttttaaagagtgcgacgtgtgtatttattgaacgccaactaccctccaggctctatattgtgtactgaggaaacactttggagtggttaatatttagctttgcgaccttcagcaagttatttaaccgagtgaagtcagagcaggaactcaagacaggtcatgaagctaaaaccgtggagaacgctgcttctggaccttctcttctgctcatgcctgggcgctttcttgtaccacacaagcacacctgcccagggatgatgcccacctacagtgacctgggccctcccacttgagtcaatttctcacagaccagtctgatggaggcaattgtttgactgaggtttcctccttccagatgacccgaggttgtgtaaagttgacaaaaaacaaccaaaacaactaactactctagtaaatcccatgccatgatgtgcttctgctctttctcaatttcggttggtagcgtgtagcgtgaaatccctccaggtgggagtgtttacatctttgaaatcagcaaacaccacaaatcaggggtttggagagccccttgataagcattaacggaatacctcttcattagttaatgtattaaaagtgctaaggcgagtgcttaaagattagctataatgattaattatacaggagattttagaaccatgaagaaaatggaacagtgcatcaatagtataactatggttaacaaaaattagtgcatatttcaaaatagtagcagaggcttttgagtgttcctacacaagtaaagtctgaagtcatatgccagttaacctatatgactattatacattgtacacatgtattgggttatcctactgtaccccataaatatgtaaactgtttcagttaaagataaaaaaaaattgctgggaggtggtggcacatgcctttagtcccagcactctggaggcagaggcaggcagatctctgatctacaacagctagttccagcacagcctccaaagctacagagaaaccctgtctcgaaacccccaaaaaaattttaaagaaaaagtgcatgattgagattccctctatggctggaggaatggtggtaacataacaagctggtcagggaagactggacaagctgacatttcagatgagtactagaggaagagaaactaatcatagctagaacaggcaacagactccggaaccatgaggatcaaaaaagagggttggagagctggcccagccactaaagtctaggatcacaacctagactaggggagcagcaaagaaacaagtccaagggaggagaacagcatttgttttgaaaggagaaacacataatgaggcaagcaggggcctcttggctgtagttaacaagctggaagttattcaaagtacaagctatgtgccattggaaagtttttattttttttgttttttgttggccattgaaaagttttatttctttttattttcaattattttggtttccagggactggcacttatgtagcccaggcaggccttgaattcactgtgtatcaaagatacaactgatcttcctgtctttgactcctgaatgctgaaattatagaattgtgtcactgcttctggacgttttttaaagtatttaccttatttgcattggtgttttgcctgcatgtatgtctgtgtaagggtgccaagatcttggagttacagacagttgtgagctgccatgtggctgctggacctgaacttggatcccctggatgatctcagtgctctcaaccactgagccgtccctccagcccctcctgaccttttttgtatttttgtattttgagatggggtcttgccagacctggcaatctgtataggattttaagtggcctcaaatcaatggcaatccttgttttagagatttttattttatttttggtggcataggggaggcgatgaagtacatgtcaaggtcagaggctttccacctctgcctcccaagtgctgggccaaagcatgccctgctacacccagcttccactggagagtgttaaccagagtggtatcagatgcttttattcgtggactttttgagggatgggggcgtgtttcctttgatgctagggatgaaacccaaggtcctggtgcatgctaaacacttgcactgcaactcactttccaggtgtgtgtctaaaagatcactatgttcccaagcctatttcggtgttagagaatatgatgtgatgacaaaaattataccctctacctttatgggactggaagagttggttgagactatatagatcttaagaatgacataagtcaggctggagaggtggctcagtggttaaaagcacataccactcttccgggaagatctgagttcaagtcccaacgccaagtgactcacattgtaactccagctccaggggatctgatgtctcctgtgtatgtacccacacagagattattaatgcagaccagtcattaaaaaataaaacaaatcttgttttgatttgtttttttttcaagacgggatttctctccgtagtcctggttgtcctggaattagctctgtagaccaggctggcttcaaattcagagagctttccctaactctgcctcctaagtgctggaattaaagatgtgctccaccagttctggcaaaacaaatctttcaataattaatattaagtcataaacaatgattagagggagatcagtatgtcaggaaaatgtaaaaatcagctccaggagtcatatctaaggaacgggggagagggtggtgaggtcacaaaggaacagaggaggacactcttctttgagtccaagccctgtgacatactctttgcatgagcttatttagtttacatttttcttcctaaaaatacagatgttggtatatgcatattgcattatgaaaattggaagctgaagtagcatcaactccatagtaagactgaaaagactgtacacagtaaaaggtttagcacatatatctagtgtctgacacacaccagacagctgctgtgttagttacaccctctttttttaatgttttaaatttttattattttacgcatatgggtgttttgtctgtgcatcttgtatatgcagtacctgcagagggcagaacatggtgttggatcccttggaaatagagttatccacagttatgagtgaccatgtgggtactgggaattgaacctgggtcctctgggagagcagctagtgctcttaactgctgaggcatctctaaggctcccagttacatcattttaatagataatttaaaagttcagctgggcgatagtggcacacgcctttaatcccagcactctggaggcagaggcagatggatcactgtgagttcgagactagccggtctacaagagctagttccaggacagcctccaaagccatggagaaaccctgtctcgaaaaaacaaacaaacaaacaaacaaacaaaaaattcttgccgggcattggtgacacatgcctttaaccccagcactctttgggaggcagaggcagatggatctctgtgactttaaggccagcctggtctagagttccagaacaggctccaaagcaatacagagtagccctgtctcgaaaaacaatcaaacagcaaaaaaagtaggattgtctctggggagacaatgaccatgataaatggaagtgagatccaaaccaataattctgaatcatggttatctaatatatcactttgtaaaggcttgcaagaactaaaactcagaagaaaacagactaaattttcacaaaccatagttaaacaatggtttctttactacctcactaaatatgtgggcaacaagagaagaaataatttggctcttgcattaacttttcgtggggagaggagaacaaacatgtaggtgcccatgagaggcacctacaacagaacaaagaaacagttgcatccaggtctagcttcatgaaccaatgagtttaaagggtttacttagagatggataaacaaaaaggtcctatatctatacaatagaacataggtaggcaataagaaataatgaagttttgagatatgccacaacatgcaagagccttgaaaatatgctaagtgaaacaaaccagatcacaaaacatatgtcttttaattccatttatatgaaatgttcagaataggcaagtatacagaagaaaaacttaagacttgaggtagctaagagaataagaaaaggtacaatttcttctacttctcttccttctgtggtattggggattaaacccacagtatttcctttctcatgctgagcaagcactctaccactgagatgtatgccagcattatttttcttcttctctcctccctcttcttcctccttcttgttcccctccctctcctcctacccctttctcttcctccattcattcttccttcttttaggctgctctggcctcaaactcactttttagccaaagatggccttgcactttgaatccttctgctaacacaacctaagtgtaggcagtacgtgtgtgagctaccgtgccccattgatgttgtgctgaggtcagacccaggccttcagcatgctaaatgcagtctgtcgactgatctacattcctagtcttgccttcttttccatggcgtgtgtgtgtgtgtgtgtgtgtgtgtgtgtgtgtgtgtgtgtgtgtgtgtgtcttttctctgttctcacatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtgtgtgtgtgtgtgtgtgtgtgtgtgtgtctctgtgtgtgtgtgtgtgtgtgtgtgtgtgtgtgtgtgtgtgtgtgttttagaagcagcctcctcctatgtggccctgacgactgggtacccactatgtagtccaggctagcctagaacttgcaacaatcctcccgcttcagcctcctgtgacatctacttttattttaagacaaattgcccaggttggccttgaactttaaatcctcctgtctgtcttcttcccagaagccgggattacagagctgtaccaccaggtaaagtatcgtaacacagcttctttgcaaagtagtcaaaatgttctaaatttacgttgtagtgatggttctgctggtctgtgagtgtgactgaaagatcactcagctgaatcaggtctctccctctgccatgtgggagccatctcaggtagtcaggcatggcatcaggcccataccttttgagccatctcactggccccagaatgtatttttttttttaatgtaaactcctccagtctgccctaaaaactgtgattcaccatgctaaactgcatcccttattacttcaggaaattctgatgtcgctgactcagactccataccttgaaaaatgtcatgttgaaaagcatacatgcccagtagcctatgcaccaaaagagtgaaaagaggaataagttagcaaatagtgcttacaaggggccacggactctaagtgttccatatgtatatacactgttatagctgctgttgtgtccccatcactatatgaggaaactgaggtataaagggacttagtaatttgcccaaagtcatatggcaggtggcataaccaggatgtttacgtaagctctaaatattatagctagttgctctgcctgagaaaatgagaggaatttggtttgggttgggttgaggtggtttgggttgttttgtagttgtagctgaagaagaagggtatttaacaaaaaggaagttataaatgatgattccttgtggatggttttttttttgtcccaccagcctgctcccaaaataatcacacagagacttattattaattataaaaattcaggcagctgggcgttggtggcgcacgcctttaatcccagcactcgggaggcagaggcaggcgaatctctgtgagttcgagactagcctggtctacaagagctagttccaggacagcctccaaagccacagagaaaccctgtctcgaaaaacaaaacaaaacaaaacaaaacaaaaattcaggcaatagcttaggcttgttactcactatgagtatgcaacaagggaggtccatatggttggagttatggaagcaagaggaaaaactggggaagcaggtaagagtcagatagcctttggggaccatgatgttaggttgaattcttatcctaaaaagaacaagaaatccatgaaagagggagagtttccagttagaacatcatcacaaattagattttttgtgggggtggacaggttctcttgcagtcttgggtgccttaaactcaatatgcggctgaggatggccttgaacatttgatcttgtctcaaccttctaagtactaggattacagacataggtatcacatgccccatttaaacagtgctggggacctagctcagtgcttcttgcattatgagcaaacattctacctatatctccagcccccgaacttagggttttttgtttgtttgagatggggtttctctctgtgtgtagctttggctgtcctggaacttgctctgtagatcaggctggtctggaactcacagagatccatcaagctgcctctgcttcttgagtgctgggattaatggcatgtgccatcaccactcagcctcaaatttagattttttaaaaccattcttctgctccttcatcctctttatttacttagaggcatggtgacacacacctttaatcctaggctcaggaggcagaggcaggtacatctctgtgagttccaggccaactaagagtacccagtgagactctgtcttacaaaacaaaacaaaacaaaaaaaacacaacaaaacaacaaacaaagccaggtggcgatggcacacacatttaataccagcactcagaagcatcaggatgaatctctgagtttgaggctagcatgttctatagagtaagtctcaggacagccaggactacacagagaaatcctgtctcgaaagatcaaaaataaacaaagcattaaattaaaattttaaaggcagaggtcagttaagaaagaaacctggttttgacctttgcacttcacacaggtacaaacacgcaaacacaaacacacacacatacacaaaaaggtaagtcagagctacaatttcaaattgagtacatttaaaaaagtgtgtgtgtgtatgtgtgtgtgtgttgcctgcatgtatgtttgtgcaccagggtgtgcctggtgcccctggaggccagaagagtgtgtcagatatgctgggactggagttacagagatttgtgaactgatgctagggatcgagcctgggtccactggaataacagccagggctcttaactgaagagccatcactccagcccctatataaaaattttaaacataactagaaactgctgtgcaacaatctttatacaatgtaaatatgtattactctcactggttaataaagagctgactggcccatatctgggcaggaagagattgggcaggagagccagagtaggagaatgctgggaagaagaagggggagtgagaagagcatggagaagatgcagagagaagcaagatgtacacgctgtactgagagaaggtaccaagccacatggcaaagcgtggataaaaagaggggttcactgttagctaggaacaagcctgagatactggctgagcatttataataaatattaagcctatgtgtggttacttgggagcagcttgtggaactgttacaagaaacttctgacaacaagaaactatttttccagctacctgataaccagctaccattatgaacggcagaataaccagctaggatgttcatgagattccaactgacaattttattaggaaaataagaccaagatataaatgaggtctaaaatccatatatttcacacaagtacccatagaaatcaatagaagctagccagaagtttcataaaggtaaatcaaaatttacaagaacacatcagatttgaagaccactttgctaatggcaaaagaagctttgacattaacttgaaaggtggcgcatgtctgtaattccagcatttgggaggtagaggcagaagcatcatgaatttagagccagcgtgaactacacatatagaccctgtctcaaaaacaacagaaagttaacaactccttgaatttacgcagagaaatcaacccaaacatagactttccagatacacctgaatggagaggaaagagctcaaaaaaaaaaaaaatcaccaaaagaaacactaataacgattactagaggctgtagacagatttttctttggggccaccagctcacaaaaaaaaaaaaaaaaaaaaaaaaaaaaaaaaaaaaaaaaaacctaaaatggatgcttggtattaattaagcatggtgctggcagccagctccagccagcaggcaacagctggtagctgcacctctatctgccacccagcaccagaccacctgagagactgcaggattaggaagctacatctgactccttgttcagtcagaactttccttacccccccccctctatttgaacccccacaatggacaccatatgtagatggatttttttcactgagccaacagctcacaaaacaacaacaacaacaaaaaacagagacttattctgaaagctcagcctatagcttaaggcttatcccactagctcttataacttaaattaacccatttatatcactctaagttctgccccctggctttttacctctcttccatctttcacctctccatgttctgacatctctcccttgcctagattcctctcctgtctttctccctgggcctgaagtcctgcccaacctcttcctgcctagctattggccattcagctctttattaaaccaatgagaaggcaacttggcaaagacacatcttcatagattattccacaagaggtcaggttgggcaacatgaggtcaagtacatcatggcagaagacaggcttgctatgaaggaagtcttggcttgatctatagcgaccatgttgttttaccaggaggaaatgaactctaataacttgaaaatgaacagtacaaacaatatcagagagggaggggaactgtgggaagtaactgtgggggaagacaatccaagggatcctggagatttactaaagaggaaggaccctaacctagtcctatgtatggattggaaaactggagcccagagagaggcagtgccaggtgcaggaacacacagcaaatcagtgtggattcagacccaaacaccagggtctcaccatcagcctcctataatgtcagcctccttttcctgggtcagggtctctgcgaggcttactagaacacacacaactagttctctcctcaatcctccacccaaatgttgtaagccctcctcctcgtcccccccccaaaaaaaaaaagaagaatggaggatctggacttacaggcttatgtaattcctcaggacagatttcagagacccaatgtccacagatctaccaatttccttcctacactgtacccacaaatgccacaattacaaaagtcatcctgttaggaaaacaacactaagatatgactatggctaaaaaccaaagctgtggcttcattcctttatcccccagcctcctgtattggaacctctgtcctcttcctaagaggctatgaacccaggctctgtgccccaaatatacacaccttctctgctctgggaaaggaggtacatatcccttgtctttgttgttctctgatatctatacccccacccctgttttctcttcctagcaagaccttgaattcctcagccctcattccaggaataggtcttaaatcatttaaactaagaaatgcatgcttgctatggaacaatgtttgtacactgtaaatatgtattactctcattggttaataaagagctgactggcttatagctgggcaggaagagattgggcaggagaaccagactaggaggacactgggaagaagaagggctgagtctgaggggtaatgagccagatatgtagaaaaagacgtaacaagtcatgagccatgtgatagaacttagataagaaatatgggctagctaatttaaattgtaagagctagttagtaacaagcctaatctatcggctggtcgtttataatatgaagtctctgtggggttatttgggagctgaccagtggtccagacaaaaaaaaaactctgcctatacatgctaaaactcttaccatatcatggcattatcatgactagctgaaggatgaacgtgtgacccacatcaggctatttagagccaacaaaactcaattctgagattttggatgagccatttgggaaaatagatttaccattttcctttgggtttaagtttagaatgcacctacacctaagagcagctggcaacttcttgccaatcttatccatgctcagaaggcaaggccaaagcctgaatggttctactaagatatagtgaggtgaggcatcttccatgtaaacagtttgtgatctgcacagacagcaagcacatgccaagcccttataatcctgtcctacacacctaaaaggttgacactgacacacagaattaaacaattgccctgtgagttaggaggtggatactctgtcactaggagccaattccacatggcagctaagttacacattctcagctgcatcctgaacagaccgagagggatgggggtggggtgggggtggggagggcagaaaccacctctgcctgaggatggaaagatgactcagctgttgagtgcttcctgctcttccagaggacctgactttggttcccagcactgtcaggcagctcacaactgcaactcagacttcaggggatctaagacacacagacacagacacacagacacacagacacacacagacacacaggtgctgagaattgaacccaattgaaccaatgttcttaactgctaagccatcttttcagtccctttttaaattcaaaatctaagccaggcggtggtggcacacgacattaatcccagcactcgggaggcagaggcaggtggatctctgtgagttcaagaccagcctggtctacaagagctagttccaggatagcctccaaagccacagagaaaccctgtctcgaaaaaccaaaaaaaaaaaaaaaaaaaaaaaaaaaaaaggaaaatctaaaaaaagataatcctatgcttcaacagattctgggaagccacagaatggtctcctgtcagcctcccaggggagaccaggggccaggggagaaggattttcctgtctgacaagcctcctcatgctctggggcagccacaaggcattctgccaagagccagatgaactattcacgccttaggccttcaacctttccagatttatctggggttttagttccaactcccaacttttcttaagttcaaatgtctgttaaaagcccaagttgtttgttaaggggttagttgtgtgttcaaaagaatgctgtgtttttgtttccagcatttccgtgtgttatgtagcaaggagttccagatattgtcagcagaggaagtctagcttgatgctgagtaaactctccatcgtcactgtctgtttacttttttctctgtgagtatcaagctctgggagggcagggactcagctgactcatctctggggacaccagctcaagacctgagacaaagtaaatattgattctaaacttccacttggatacctctagtgatgggagctcatgggcaatgagggactaccttctcctcagccatgtgcatcttttcctgctcaagtgtccgtcctgattgtgcagaagggacaggagtcaagtaatgactgagcattggctgagaaggaagtgcacaggccaggtctgggtgtaaacctgaggcactgactcattgctggcagaagtctaaagatggcacggatatatagcagggtggtggtggtgcacagctttaatcccaacactcaggaggcagaggcaggtggatctctgagttcgaggatagcctggtctacagagggattttcaggatggtcagggtcacacaaagaaaccctgtcttgaaaaacaaaacaaaacaaaaatagttgaaatgtgtatagcaatcaatcttatatatctgaagtatctctgaatctatttttttaaaacaggttttcttgtagctcatcatgagttcaaactagctttgcagctaaagatgccttcagctcctttgccatgactggtttcatgttgggattaaagctggaggctgaacccaggatttagtgcatgctaggcaagtactctaccaacagagctaccttttcagtcctattctaaacagaaatacctattctaaaacagaactacctattctttagtcctattataaacagaggtagttcttatagcattgtctgtggaggcaacagggaaaacccaagtgctcaacaacagtgactaaagaaatggttttgtttttatctttttttttgggggggggtcttctttaatgaggtagagtttgagtatcgacatggtacaacttccagacagtataaatcaatacatcatgcaaggtatgtactaatgtctttaatatttgtatttgggtttttatctttttttccatttattgtgtgttcagacatgaacatcatagcactcatgtggaagtcagaggaaaacttggggtgttggtgatctctttctgtcatgaggatcctgaggattgaattcaggttgttaggtgtggcagcagctgacatctctcactggccctaattttgattttttgaggcaaggtcccatgtagcctgacttcaaagtttcaaagtagcaaagaatagccttgaactcctgatcctcctgcctccacatctcaagtgctgtcattacaggcctgtgccatcacacctggctaccctcaattttaaaaatggcaattaagccgggcgttggtggcgaacgcctttaatcccagcactctggaggcagaggcaggcggatctctgtgagttcgaggccagcctggtctacacagtgagttccaggaccgcctccaaagcaatacagagaaaccctatattgaaaaaacaaacaaaaaattgcctcaactgtttagatctcattagaaaataccttaaaatatttaagcttggcatggcaacacatgaatttaagcccagcacttgggagacagagacaggtagatctctctgagtttgagcctggtccacataatgagacctgttttggtttggtttttggttttttgagacagggtttctctgtgtaacacccttggctgtcctgagctcactttgtagaccaggctagtcttgaactcacagagatccacctgcctctgcctcccaagtactgggattaaaggtgtgcgccaccaccacctggcagaattacagtggtttttaataaactattgagagcaaccttcatttccattgaaaactagccacagtacattgatatgattggatattacacgtgtgaaataaaacaaagcttccttgcacacagttaatgaacagtctcaagatacagtataagggctggagagatggctcagaggttcagagcactgactgctcttccagaggtccagaatgcaattcccagcaaccacgtggtggctaacaaccatctataatgtgatctggtaccctcttctagtgtgcaggcatacatgcaggcagaacacttatacataataaatatttttttaaaaaaagatacagtataaaacgaacaaaggggcataaagcagttttatttgtatggataccacacacatgcatgaggacctagggatgtggctcagttgctagagtgtatgcctataaaatgagtgtgatatcagaagcctctaatcccagctctcaagatggggaaacaagaacagaaatgttaggtcatccttgctacacagctcgagatcagggctggagagatggtgtgccgattatgagtattcattgctcttgtggttgccggtatccacatctggcagctcacaactgcctgttgtcaccagggatcgccagttccccaggaaatgacagagactcattatgaaagcttggccaataggttaggcttatttctaactagttcttatacttaaactaatgcatttctattaatctacatctggctgtgtgactcttggcagctgcctctcctcctgcacgtcctgcttcctctgcctctggctggtgactctgtcatcctcttcctagcattctctctgccccccaaatcctgcctagctattggccgttcagctttttatttatttatttatttatttttgtttttcgagacagggtttctctgtgcagctttggagcctatcctggcacttgctctggagaccaggctggcctcgaactcacagagatccgcctgcctctgccttccgcgtgctgggattaaaggcgtgcgccaccaactcccagctttcagcattaagttttttttttttggttcagctttttattaaaccaatctgagtgatacatcttcacagtgtacaacagtattattccacaacagcctgtaactgcagcgctaggggaatccagcgccctctactggtgtctctgtgcaccttcactgatgtgcacagacacacacataattattaaaacacgttaaagtaaaaatctttaaaaagcaaaacagtggccctgactatatcttggttgaattttacatttatattttaaaatcatgtaatttttatacagaatattaaattgttgcattgtttaatatctattttaatcaataatagggacttcaggtggcaacagagtgacgccaactctccttcacagaaaggattcatgtttcacttggttccaccagccttcccaaggacactgggcttagagataggcacttgggctataaaacatcattcccagcagtttctcctatcacctctcacccatttggcttcctgtcaccactgggctgaggactgattataggggttgtatttccagaggtcccatcaatagaaggctgagaagagccagtccaggaaaaatgcgacatttggctttacttctttgttcttccagccacacttttactggctccacctccaacgtatgtttctctctgggtccattcatcggaggcatctgaaaactccattggactagatagaaagggagttagcattccattgtttcaactattattgtaagcgatatctaaaaggagcaatggtttactaagggagatacaacaacactgaactatggtgtattaagaagcaaaaaagactttacttttattctggagtccgattaataggcaacagtgaataatgcttaagaccaggccagatcggtagagtcataccctacccagtctgtcactcagcagctgccaaaacttagacaaaccttgtgcctcagtttcccagtttgtaagagataaaagtagcttcatcatagggttattgtgaagctacattggaatatcacatcaagtgtttgtgggtgtgtggatgtatgcatatgagtggctgcacctgtgtgtgggtacacatgtcataggtggacatatgtattcatcctatgtgtggtcctcacctccctttgtgatcacacatctatctacctttgcacaactgaagacctactttctgtcagtgtatataatttttgtctattctagaatttcatataaatgcagttgtacaatgtcttttttgttttgttttgttttttcttcttttttaaaaaaagatttgtttatttattacgtatacaacattctgcttccatgtatatctgcacaccagcagagggcaccagatcttataacggatggttgtgagccaccatgtggttgctgggaattgaactcaggacctttggaagagcagtcagtgttcttaacctctgaaccatctctccagtcttgagtttttttgttttgttttgttttgttttttgttttttctagacagggtttctctgtggctgtcctggaactagctcttgtagaccaggctagtcttgaactcacagagatccacctgcctctgcctcctgagtgctgggattaaaggtatgcgccaccaccgcccggctacaatatgtcatttttatgtctggcttctactcagcatgttttttagattcgtctcaatttgtggcaagcattagaaggctcttttttattgctgagtaggggtctattgcacaaatacatcacagttctggcttgatattgagagtataaaggttgatggagtttcaattctagggagagatggtagagagacacaaactgaattaaaccccccgcccattcttccttccctctcctttcctgtacataaggaaccagaagacttctaaataactttctcatgcatcctcagtgttttaagcttctcttctaaaggaaggctcacaggatggggctggagaggcggctcagcagtcaggagcactgggtgctcttaggagtctcacattcagtctctagcatccccatagtgctcacagcccttatgtaaattttgagaactccacaggcaccaggcacacatgtggtgtgcagacattcaagcaaaacactcagactttctaggcccatttcatccatattccctccccttgtctgcagtcacctttctatttgagcccagctttggcctttcaccacagcctgctttctgaggctcttggaacccacccggcaccctcctcccggtctgatcccagctaagaatctatcaccagagctttggggagaaaatccagggacacaggttctgaatactgtgcaaatattgaccaatccaccctagaccttgcttattgtcttccagcttgtctggttttctgaattctgtcatttcttcccactagaggaacccagtctattctaaattcaaagaggctgacttttacctatgagccttaataagtctccaagtcattatttgtgacctggtggtccaaacaagaaaatttgtccacagtgggacaagactgtaatcctagctactcaggaaactgaggcaagaggcatgaaagttcaagactagcctaggcaacttaaaaaacgctgtcttctaaaaaaaaaaaaattcaaggggcaggagagatagcccagcagctaagagcccattctgttcttccagaggacctgagttcagttctcatcatccacataagatggtgtacaactgcctataactccagccccaagggatccaacaggcctccatggacatcaggcatgcatgcggcacacctttacacacacacacacacacacacacacacacacacacacacacacaccttaaaaatacatttcaaaatgtatgtgtggtacactaccacttgtgtttaaagtgaggtgattctctctctctctctctctctctctctctctctctctctctctctctgatccatgtgcagccctgaaaccatctcactccctggaagcagtgcacgtcacctgggacacaggggaagcatggcaagcccctcctgctctcatgctggggggtggctttttgtttttgtttttgcctctgcctcccgagtgcttggattaaaggtgtgcaccacgacctcaccatcatttacttgtgcatgtttgtatatgcagaggatatttctgccccgtctcaccagggactggtaagggcagttttctctgacaagtggtggtggagggaagtaaacctatcccttttgttctttgaccttttgaatcattggtagcctattttgtttatttagaatcagtgtctcatagagcccaggccaacctcaaacaccctatgtagctgaggatgaccttaaattacacatctttctgccagatccatctcccaaatgctggaagtgcaggtgtgcgccaccacagcgggtctcaaaaactgtttttattcaaaccaaagattgagcatcctctgagtgtaggatggtactcactgcctcaccccattgtctaatacttgatttctgccacctcctaagcactggccttttgggtttgggagacgagttcttggttatctcagaatgcaaacattctaccactgtgcaggttggggaagttgtgggaagcaagccaataagcaacactcctccatggcctctgcatcagctcctgcctccaggttcctgcttgagttcctatccttactcactttggtgatgaatagcaacgctgaagtgtaagccgaataaaccctttcctccccagtttgctttttggtcacgtttttggtcatggtggtttttgtcatggtggttttagtcatgttgcatcaatggaaattctaagacagcccctctctgaaacccctccttctagaagttgtcttggttcatggtgttttatcaaaaggacaaaaaggtgcttttcacactcaggcctggcaaccctgagttcaatctctaaaatccacttaaacttggaaggacagaaccaactctgtcctctgacctccacacatgtatcatggtacacatatcccccataagtaaatacaaaaacactaatgttctgagtctctccctaaaggataagtggttactgctcaaagtcgatgtggataagggcttgagtggctggatttaagaaaagatttcctccctttcagtcttagtttcttgaacagtaaaatagaacaactatattatttgccaggtccatgcataggcttgtaatatcagcatcttggcaggctgagacagagtgattgtacactgaaggcctgcctgggttagagagtgagttcaaggccatcctgggaagctttggaagctgctgtctcaaaagaaaaaggaaaagagaggaggtgactgagtggtaaagtggctgcagagtatgcatgaggccctggattctatcccccacactgccaacaagataaaaaagaatctattatctatgcttcctctatcttcctcattctctatcttagagcaaaggttcggggagaaagaggtggggagtgaccagcctgttgtcatcacagactggctcatacctgctgtgcacattcagggtcccatgaggaacacacccagtctgacacatctcagccctttaaagttgaggcctcaagccagttcagagtcctcagggcatggtaaatgcaagcccaaggcctagacacaaacacaagactggcctcttgacctccagtcctaatgcccataaaattaggcagatgctcatgcttggaaatgaggggggaagagttagattggattagatgggcagggaagctgtagtctcatgggtgtgaactcatatacactgtgtgtatttgtacacagatatcatgtacatacatggatatccataggaatggtactttggatgtaaaacatcagggcatattcctagcattatagtcactacttttttttttttgttttttttttttagagagaggttttataagtataggtgttttgtctgcatgtatgtctgtatatcacatgcatgcctggtgccacagtggtcacaaggggacatcatatatcctggatacagatgtttgtgaggcactgttttggtgctggtagtcgaacctgggtcctctggaaaagcaatagtgcttttaaccactgagccatctctccagctcctttttattttacattgtttattttggcagtaccgggtattgaagctagggcatcaagcatagggggcaactgctctagcactaaaccacggttccagcccccttttgatagttgccaggcccaggctagagtcccaagtagactggaatttggcctagcagtttgaacattgggtacagccaatatcgggaacagaatccaggtcaattagggtaccagagtatatgccaagagctgtattctctagacttggggaaccagaattttgtgctccttccaagatagagggtccacggggagactactatgccagacactgtctatgggcttcagcttacaactactaagcctttgattagaacctttatacatcagatctgacatatagcttgactgggaaaatatgtggacaagaccctttccttgggatgtcaaacattcacttgctaagatacatatacacaggcatcaatacttgcttgttattttttttaaatatatattttgggttttttttttgaggcagggtttctctgtggctttggaggctgtcctggaactagctcttgtagaccaggctggccgtgaactcagagatctgactgtctctgcctcccgagtgctgggattaaaggtgtgtgccaccactgcccagataatttttttataaatattttaagatttttatgtgtgtggatgttttacctacatgcatgactgtaccacatttacaatgccaagaaagctagaagagggtgtttcatcctctggagctgcagttaacagacgctagtgagctgccatgtaggttctggaaatcaaactcatgtcctctggaagagcatctagtgctctcaaccactgagttgtctctccagcccaacttgcttgtcatttaattaatagaaaactagagaaatggttcagtggtgaagagagtttgcagatcttttaaaagtattttaaatgaggtgtataaagtgttttttttaagttattttttattttgtgtgtatgggtgttttgcttgcatgcccagctgtataccacatgcatgcctggtgcccagggaggtcagaaaggtcatcagaccccctggaactggagttaagatagttgtgagctgccatgtgggttctggagtcaaatctgggtccccagtcagtgctttttaactgctgagccagatctccagccatattaaaaaaaaaaaaaaaaaaaaaaacttcctatttaatgtacatgggtgctttgtctgcatgcctgtctgcaaatcagaagagtgtgttaacccaattacagacagttgtgagccaatatgtgggtgttgggaattgaactcaggacccctggaagagcagccagtgctcttaatctctgagccatctctccagcccatccagccagatgtttttttatttttaattgggcttctctgagtatggtgacacatgtctttaattctaatacttgaggggcagaggcaggtggataggtggatatctgtgagaccaggccagactgatctacgtagccagttccaggccagccagagtctcaaaaaactgatacacacacagacacagacacagacacagacacagacacagacacagannnnnnnnnnnnnnnnnnnnnnnnnnnnnnnnnnnnnnnnnnnnnnnnnnnnnnnnnnagagagagagagagagagagagagagagagagagagagagagagaatgtgcacactgactcacactgttgcccaggctgttcctaggcactgagtaggtagaaccacaggtgcaagccacacactcagctacttactatttactgaacaaacaaatgagactgtccatcaaagtagtctcggacacggacacatgagtagggcaagagtggattcccctgagaagccatggaagaattttgaagacaggaagtaattttagaaaggcatgaaggaggcaatcaaggaagaggagagcatttaacatggaggcgatggagttttactagcacagggtacacagagaagaaggaagacggagctggagagaacctgggttatgaagagctatgaatgctgttggattgttgagctttgtgagaatatgaggttttagaacaaacaagtggtgtgacaggagggacatgttagggattagtttgtcagcaaggaggtcaacagagggtgtgggattagtgggaagtggctgtgctaggcagaggctcaggtttgcacaaatgagggcacgttggaaactctagtgtaaggaacacagtgcctattgcctcccctcaagcctctgggtattattttctggctctgtcctctgcctggcagtattcagtcctatcttagagctttttggcctggctgaggcagggttcttgaaatcaccagagcatggagctctgaactcgctcctgctggccaaatgggcaactctcagagcctcatctactagatctgttctacttagagattcagaagctctagcctggaaatccccaggaccggtgtttgcaatttctccccaagtgtctcacaggccattgcaagaactggggcctggagcatgaacatggtggaattttggggatgaagagtctggaaaactctcactctattggccctaaatttgaatatatatgtcagcaggaaagatcgactaaggcccagagtggtaaggacttacttggcaccacacagtcgggacacaggactggaagccagatctcactggagacacttcagaatcctggagttcagaccctctggtaaaggttaaatcctgtgatttagacttctgcttctgccattgactatagcttaattaccttggcgagttacttacattctcctggtatgtttcttcaactgtaagaagaggatactatttaccttttggggttattgtgaagattaaatagcagccgagtgctcggcatatggtaagtgttcaatgtcagctggcgatctggcagaagcagtagtaacccccctctcgcccccgtttcctctctctgagacttaggctgccttacctcttgaacctctcgtctacctaccaagtgctgggattacaagtgtgtgcctgtattctgtttttccatatgcaaatcagggccaacaatccctgtcttgtcactcctctgtcctgttccggtagcaacgtgtactaaataaggtgtgtaaacctcctagggctgagctgtttccaggtcaatgtttgttcagcttagagcaatttctttccaaggcctactctgaccaaatttcccgtcagccccaccaactcccccacactcgcaggtgctcctttgtaactgcagaaggggaaaggtccgctccagcccagggaaaaaaggagagctgggaaaatggaaaacgtgtagggaagagatgggacagaggaggaatagcaggtaagaagggcagtgaggaagagcggcgaaggataaggaggggggtgaaagggacttacagatggagtgtggtgggggtgagggggtcctcctgagctaagatgcaggctaagggatgtgcggagcactggggcaagtgaaagagcaaggttatgtgcaggaagagcagcgaggtcgaatccttgcggaagaacggggcggagggggggtcgccatcagtgcgaggtctgtggatgactgggggcagggaatttgggccgtcacctccactcggtcggaggttcggagcgcagatcccgggctgcagccacccgcaggcgaaccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttgtctgttctttgtctgtctccgccggcggccgctggagctgcgttctcggctctctattggttgccccaagccggtaggccatgacgtcgcttatttgcatatgacattgagacgtcaccaaggccagccccgccttccaggcttgcttgggtgcttgtcctctggtgacccggtgggcgctgtgtcgagcccggcccagggttgagagacattgaaaggcaagcaatacccgaggggactcggcggtttcccgggctcatctagagactggggtcgggcctctcatctgctttttccttgcaacctgaggaagggtcagaaggcacagctcaatctaagttgagagggaggtcggtggatcaaagagacttcagagtccgggtccacgagacagcaccagatggcagctgatgccctgtcttcaggctccgccccccccaacataataacatcgtgctaatccctgacatgtgtgcaaagccttggttgatgtcattttcagcctacagatattgagggtcttaaaccccatttcatggaagggaaaactgagacccagagagacatagcttactggagaactcagccaattagagtcacactctatgagtgacaggttccttagctgggggcaaatgcttagtacaagctcagttcaattaaccagctatatatccatctactggggaccctatcttgggctcagcaccaagccaatttgatagaatgtttcagtctccccgattctggacatttttccaggaggtccgtaaagattgagtcggtttcaaggcgaccttctctgccttctctctatcttagaacccaataaattgctgtctcccagctgttttgaccacagaacggtgagtcactagttgcctgcctccggtgtctcccgggcagatgttgttgagaatgagttgggagttccctttattggcctctcatcaccttgtcagatcccaagctgtcagctaggaggaaccagaccttccctagcactagtgctgtctggagagtcttcttccagaggatcagaatgttcctttctttccaagtgagtagatatggaggctggatctggatcctcttcccaggctggggtttgttcaggaatggcctgggctaggggtggcttagggctcaagtgctattctgggcacagctgctgtagtattaagggaaggttcttcctggagtggagccaggaaactgagaaccaggaagccagcaggctagggaagaaaacccaggaggctctccttgtggtcaaagggaggagtgggcagtcatagctggctggttgttgtcatctctcctggctgtcactgactcctgcatgatctccaccaggtaccttctctgctgagcctcttacctcactcaacatgtcatcagttgaggttccttgcagggtctgatacagcaggaactctgggaaatacatgttagaacttggtgatggctggatcaaggcactagtccaatctccctgtcttcggtgcacttttactttcttgaatattatctttgaggcttttctgattatatatgctctgcatttccccaccactactaagctgtagcttttttgatagattaacgttatcactttgaggtctccatcctagaacagggggcttcttttttgtcttggtccagggaaggactgtctgaaggcttgggtcttggtccaacccttgtgtttatccttaagggatgcttagatctgactgcttccttcttccatcatctgtcactgacatgttgttttactagggtaaggcaacacaatattctttgtcttggccagagatgctgtccttgaacaagagtctgggggaaggggttagagtaaggaggacctgtgagcataggatcttacacctcatctggaatacacatctgagggtcgtccaatcccatggtgagattgtagcaagaaccatgcggtttctattagcacttttcaagccacacaacgtcctatgagtattattgatctctggggtcaaagattgctgctcagaaaaccttgctgaaatccaagatcttttttttttttaacccctagaaaaacacacctagacacagccctagttacaaagctaaaaatgtctagtctagacagataacccagaaaagacaggagtggactatagtgattatggagccactggttatctggattcaaatgctacctgtgtcttactagctgtgagactttgggctagttgctttacctctctgagccttgttttatttctctctttaccagaaaaaaaagtagatgttctctctccctttctcttccttttgacaggatctcatacagccacggactgttatttttttaggtagggtcccatgtagctcagactggctttaaacacactatgtagctaaagcaggacttgaactcctgatcctcttgcctccaccttactaggatgatagatgtggcttctcatgtctgactttaaactttttgatcctcttgtctctgtctcccaagtactaagattacaggcttgtaccttcataccttgctctgattctgtgttattgtgaggactacataggtaaaacagatggagttgcttaggatggtacctgacacatgaatattaattttatgatgatgatgatagtaagagcagtttcttccctcaatggaaatttcctatttacttttcaaagctgtttcattctccagagacaaagcctagtcatatatatcacttcttccgtatccccaaagcaacctgtagtaacagcaaatatattagcttattggacacttactgtgtgctcaggcactgttctaaacacattataagtgtttagctcatttaattctgattaggatattgtttgacaaataagaatacaaagaccaacagtttcctgaattcacacaggaaagcctgctgactgcagaaaagcacacacaagagcctgcccatgctcagggtcctggagccctctgtcccccagccaccaccattaggtagactttagccttaatgtctttctctgcttcctaggttttcgcactgccatagggcgcccccttgaggttgcttcacccgctgaccatgttccagcgctttaccagccttttcttcagcactccttcgcctcctgaagactccaactgtcctggggccttcgtctcagaggaggatgaagtggatggctggctcatcattggcctgcagggtgaggcctgagtcagggggccagcactaggaaggcaccataaggacagggaggccttatgcaatatggaaggggaatgtggctatttgggaattggagtccccataggcctcctgggcaaaatgaagttgaggcagtgcgcctagaggtgaggtaacacagacccttctcccgaaagccctgtctgtctcctgatttgttgggggcatacacctggggccccctagggcagcagggtaaggaccctggctctcaggtgctctctgggcacgatggacaggggctgtaggtctgactaacgatgccctttctctccccatcccctgtttccggtatgtgtgtgtgtgtcccacccctatcccctgctgctccttctcttacgcatggctccccactcccacaccctatagacagctacacagctcccccaaaccctggggcttctcctgctccggcaggccgccctccacccgcgccctccttgatggacgagagctggtttgttacccctcccgcctgttttactgcagaggggcccggtcttgggcccgcacgcctccagagcaaccccctggaggacctcctcattgaacatcccagcatgtccgtttatgtcaccggcagcaccatagtgctggagtctgggccgccctcccctcaccctgatgctgtcttgcctgaggaggatctcagtgatgggtgagtgggcacgctcgggcctaggagcctagcaggggagtgtccttgagacaaagggcgggccaggtgggtagttacagggataactgatcgtcttatggctaagatggggcttgggagagtcttggctcagacgactgggatcatcttggactgctaagccagagcgcagagtggggcttgtattgtttggggggtggagccctctccctctcctgtctagtttagctgcctcagggtagactctaagaaatatctctaattgggattgagggaagagttggtacccctcagggcatcatgtgttctgccccaagagacagggtgggagactcaagccccctgtccccctctgacatttgtactctgtccctgcagagagttggcgcctgcccgccgggagcccagggctctgcaccatgcagcagctgctgctttgcctgcgcgagcggcgctgctggagaaggctggccaggtgcggaggctgcagagggcccggcagcgggcagagcgccacgccttgagtgctaaagtgctgcaacggcagaatcgcgcccgggaaagtcgttcacggaagcccaagcaccagggcagcttcatttaccagccgtgccagcgccagttcaactactgagcgcccctgctgcacctcgagtcccgtgcagtctcctggtcccgtctacctcctctgcagcagccagtgtgttgctcgaggagtgtccagggtccgcctgcctccatctgggtaccacaacttccctccttcctaagtgtctgaggtgggatgatggccctctactcccccgatttctcagtgtctgaacttctaattcacccgctaacttctttcatccagggtcacccttcccatctccgtttctaattcttcaccatcacactccccactcctattttcccaagctcccttttcagaccccgattcttgtcatctggcttcttcactttgccctcctaacccagcgatttctaagaccctctcccaccaagacctggcacactctccaactttcagctcctactttccaagacttactcttttccatgcggcattgctcctgctcctgttcccctttttcattcctggcaattccctcccagtcctgaccaggtacagccggccacgcttgggccattgttcttaccctgtagtcaggtgtcaggctcagggttttgattttagttttccccctttctctgccctgggggctgagctccttggagctgcttaggcctggaaagtttaagtatgtggaggacagtgagttgtaagttagatgaggagaggggaacggagggaaagcgggcagcctattgggaaatgcagacagggacaggtgggttgagacacagtagggagcagggtattgtgagagctggcactgtgcttggtcagaggagctaagccctggtcttaggcttgagcctggagtctgcccccatttccttttcctgtaatcctgccttccagggtttcctgaaatctgtccctgttccccagcatctctccccccccccccccccccccccccagcctgcagccccccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccttgtcaccttcccttgacatgccaccccaggagtagaagctgggtaaggccccgacatctggccatctttgttcatatgcccaaggtgctagaattagcttaggagacatgcaggccagagggcttctaggcagggaaaagggtacacaccccaaggcaggaatgcagaggaatgatgctaaggaggatatctttgggggtaaagccgtccccagactgacagctctgccttcgtcttgcctctggccttatatttcatacttcactcaatatggctggttaataaacactcctgggtaggaggccaggagtctgttccagttcccaaatttttcttataaaagttcagggccttcaaggggctttaatgctctcccgcagggctcttcctgagttccctgtgggctttcctccctttctagtcaaatagctggagtaaggaattcttgggtagagcacagggatggggtagccagcttctcccttcttgtggtggggctcagacaccagcaacagcctcttgggatgccccgagttgtttcatattctttctagctgtccttttttaagtgtgtgctctccttcctcaaaacttttagatttcctgttacatattaacacaggtcttccctttcacttcaactccaggtttccaggcctcagagccaagccagggttggagaaaactgcattcctctgagggtaaaagtagccaccctctccgatcctttctcaccaggcttcctgtggggatgggagagggtgtccccaggatggggacagaggaagccctgctagggtcacctagcccaaggaaaagccaaatgcaaactatacgcagatcaaaaccttacaccagcttattagggccctcgtagttgataaccttgttcctgtcctaagttcttcggtgacaacctagtatacttactcttcctgctatctatcctaaggtcacttccaaagcaagcttaggatcttcagcacttccatgagctgaaactccctccagcccttcttgtctattcctcactgccagatggggcctaggctcagtcctgggcaagtgcccatgatcctgctgctgtgggaagtttgatagggcatatggctcaaatttcaaaaggcctcacccctgacttttatttctagaagctcctgtagttctagaaccctccaatctcttacctgactggttgcaaggcttatttttcttttgtactttcctatagattctgtagcatttgagtgtggcaatattttaattgtgtatagatttcttaagaaccaacactactcagtctcctgctagtctgcctcctgaagcatcagaccttgtcatactgtattgactgtgtatgtgcctttcaccttgagcatgcttcaggatttttttttcttaaaccacagaacttgaatacacaagggaaccagaattcacaaagtcctatgcaacctagacaggaggaggttagagagtctgtcttgattgatttcagagaccctagagaaatttgtaccagtttgtattaatgtcaatactaccagcactttgccaaaactaaggatgtcagagggacctgtttctagagtgagtcccaattacatcaaagggcaacttccagctttctccaataagtctgagtggttctcttgagctggtgtcactttctaacctttgccagtctagccccagcagggcactatgtgtgtgtgagtgctgtttggtgctgttttggagtatgcctgctccccagcctggaaccctctgatcaacttgctgtgacctataatgtcttaggtgcaacaaggaccctaccagagctcctgggtggctttcaagatccatgtagctttgtgtgaggggactgaatgcagacaaaccacagcctactctaaaaccttcttaccctaccacctagttccaaatggaaccaacaagttgagtgcagatctgttgggtgttttgtgttgagactggctgaaatgaaaaatctttgaccgatcatgttgtgatgtgtcgacagactcaaggacacaaccacctcgacctggtcatgtggcatgcctgtgtatgtgtgtaacaggattctgaatgttagattgtaatgctattcctgtatgggagaaaaaataatataaacaaataaaaatctatttaaagcacattatgctttctgcctgagttgagctaaagtctgagaaacactataatctcaagtagagtcaagacagagggtgttattattaggctggctttggctccagtttgtcatacaagagaggaagagggcaaataagttctctggaaagagacaatataggattcaactcataaaatattttttagaagatccttataagacacatatatgaagtaaaatacaggaatgaaaatagaggcacaacagagacactggccattcttttagtcccaagcactgggttataggacaaagagctgcccatttaactgcagaactgcaccgacaaccttgctggccagtctgagagcacctgaatggagcagcacaggaatgaggtggggaagtgccatctgtgttgctgacagtcccttgcctctaaaaatcctgggtgcctttgatatggagggttggttttactttctgagacaggtcttagcccaacctggtctcaaattctccatgtagctgaagttgaccttgaactcatgattctttttggtttttcaagacagagtttctctgtgtaacatcccaggctctcctggaacttgctttatagaccaggcttgcctcaaattcagatctgcctgcctccacctcctgagtgctgggattacaggcatgcactatactgcttggttaacctgtggttcttatgactttacttcccaagcactgtgattactagtgtgtgccactatacttgattatttgcaaacaaatgaaattacacacacacaacttgctagttctggtttgttcaaagccaaaaatgagcaaatagatacattttcttcatcttgctgggtgggcatttcaggtggcaagtgtctgagttacaaagaaggctgtgtctatgtatctatgatcacaaaaaaaaaaaaaaaagaggcttgcttacccctttccaataagatactttaaagttctatgacaaagacatttatttaacacgttcaatatttcacattgtacaaacccttagattctctttattcactggtccttttctacaacaaatacatccaaaaacactatataataaaattatttacaacatttccaaatgacaagattgctttttgccccactactgctattcacacacagtacttccacagcacaatacatcattagaagatctacaaatgctcaccctgtactttaggctgcttaagaaatgtgaaactaataacatttataatggtattagctcctttcaatacatggcaacattttagaagccttgaacttcattttgcaacaccaaaagggctgctcccctttacactttatgagacaacaggtttcagggactaggaaaaggattgagttattaaaatgactaactgtacagaaatagattaaaaagtcacagctgaaaattgctctttgtaaaattcacacacatttacaagtatcaagtcatcttccagcttgcttacttggattttcttcgcttggattgcactgcaccagttatatctgttggagaaaaggaaggatatgttcaacgcaggtagcagtgcactttaggttgtccacaatgtctagaattgacatagtggagccctattaggctccaaatcagtttatgggacacatgatttgaaaacagtcacaggctttacctgctgacttatgtggtaaaagaatggtcctgtatattaggaactgccaacttggggaaatgtgatgaagaccagggtgatggctcagtgagtaaaaaacttgacaccaaacccaaattcaatccctgggtcccacatggtggaaagagcactaattgcgtgtgatatcacacaatgtgataagggaagctgagatgtacctggccagaaaaattggcagtgttggggtagggaaaaccttatattctatcagtttgtgtgtatatgcctgggcatgtggaggtcaggggacaacttgggagtcagttctttgctcctgctggttcaagggttctgtggcaagcacccccacccctccatttctctgtgtagctttggagcctttcctggaactcgctccatagacatggctggcctcgaactcacagagccccacctgcctctgcctctgcctcccgagtgctgggattaaaggtgtgcaccaccatccagtgtggcaagcacttttaccagctttatctctaccccatccccaccaacatgatcccttacaagctgtacaatcagcaatctccctcacttattcccatcactcaattaagttacagtcacactaacagtgcttttggcgagacaccagtgagtaagtgaactgccccagaaactagcctttagctgtcttttgtagccaacccattattctgcagtaaggaacacttcttggtatgctacagttaaagtctctaaactttgtgacatggatcttcggtggcctacatataaggaggctttggagggctgggattacacaactctgcagagcacctgccaagcatgcatgaggccctgagcataatctcttgaaccaccccaccccaccccacagtgtacatatatttggaagcatttcagaacagggaacacaatcccagaacctgaaggctacataagtggcaactgagtgacttatacacagtaacagtgacataaaagggaaagactgctttgattcctttaacttcccttacacatatcattgtctcaagtcaagctactcttatctcagatttaaatgtttatttaaaacttctccagtcttctatggcagagtgcagtagtactctgaagctctacaaatgtaaatatttctttagaatctaactattgacttatttttcatacaaaatattttatcttggtactgtggcacgtaccttgtaattacacctgtcaatctcagcacttggaaggtacaggcaagggagtcatttttgatatatatagggtcttgaggatagccctggggctatatgacatgttacaaataacaaaagcaaactccaaattcaaacaatgttttaaatacctctcatcaaggtaaaacaattacttctcatatattcgttcaaaagataaatcagattcaactattttggatgggatgaattttctgatgctatattaccaggttcagtattataagcaaaaacggctttttaaaaatcataatattttggggctggagagatggctcagcggttaagagcactgcctgttcttccaaaggtcctgagttcaattcccagcaaccacatggtggctcgaaaccatctgaaataagatttggtgccctttactggcctgcaggcaacatgcaggctgaacactgtacacataataaaaataaatacatctttaaaaaaatcataatattttgaggaccccagcacccacataaaaagtcagggcagcagtgcatgcttgtaatcccagtgcttgggaagaaaaaaccaggcagctccctggagcttgctggccagctagcctggaacaattagcaaggtcagttggaggctctggagagatggctcagcagttaaaaacagctgctcttctagaggacccatgttcaattcccagcaccaacatggcagcttataactgtccgttactccagtttcaggggatccaataccttcatacagacatacatgcagacaaacaaaaatgtgcatgaaataatttttaaaaaaataaagtggagccaggcgttggtggcacacacctttaatcccagcacttgggaggcagaggcaggtggatctctgtgagttaaaggccagcctggtcttcagagcgagtgccaggacgggctccaaagctacacagagaaaccctgtctcgaaactccccccccaaaaaaaaataaggtgtagactaatactcaatatttatatctggcttccatgtgtatgcacatacatgtgtacaaacctggaagaatatatatacatatatgaaaatgaaaagattaaaaagaagctatgaataggtgaggtggtgcacacctttaatcccagcactgaagaggcaaaggcaggatttctctgagtttgaggactatatggtctgagtagcgaattccagaacagccaggactaccagaaagaccctgcctcaaaaataaaataaaataaaataaaaataaaaaaatcaaatggtgtatctgagacttggtcagatgtgactggaaatgaggtggggagagaaggacgagcaatgtcagattccacccccttttctttccaagtcaataaactggaatactgcctttgagtacaaatcaacatatgaggccctcagtaaaggtggtaatatatttttataaaatgtcttttagccccccccacaaagacagaactcttggcagaccttacagcaaaattaataataccccttgaagtcatttaagactatttacttttttgtttttggaaacagagtttctctgtgtaacagccctagctgacctgaaacaagctctgtagaccaggctggtctcaaactcacagagacccatctgtctcttttgagtgctaggattaaaggcccatgccatcacactcagccaagaccatttatttaacttgttatcttactgtgtactcagcgtgtttaacttggccttaagaaaacaatgcaattagccagtcagtggtggagcaagcctttaattcagcactcaagaggcagagactggtagatatcttagtttgaggccagctggtctacagagcaagttccaggacaggtagggctacacagagaaaacctgtcttggaaaaccaaaagcaacaaaaaccaaaaaacaacgcgcacacacacacacacccacacacacacgcacgcacgcaggcccacacacacaaaaaaccccccaaaaaacccaaacaaacaaacaaacaaaatgggaaaaaaaggagaagaaaacaatgtaaccaactttgctatgccttggatttcccatgaaattagcttttagaacctaaaataaatgcatagctttaatcataggttaggtactcttctgtgcccctggcccagaatgtgtgtgtgtttgtggcgtggtaatcatttgctgaaaacaaccttaaaacaaatacccaccataaacactgcaaatgtggctctaggttgataatgtctgcatgctgtgtggagagagctatgtagtcaggtgtgatcaggaagttatttcttccctggtgaaaccctgtgaaagatttctgtaaagaaccgttcattcctttcccatgccatgcttcctatactggtcaacaaatgcagagcaaagtcctttgttagaaacaagggcaactactggggcacagatgcagactcaaacaacagactgattacagacacacccgaggctacagccagacaaaagacacagggagagagagcggagaattcagaattgggttcactcttggtcaaactaatccaatgggcttcattttcactccttagttaagacactaagacactgagacaaagacaaagagtgttctttgagggtacctttgatgtgcaagtgacaagtggcttgggctgaaaactgaaggctggtagggatggtgaacagtgtctctacactaccatgagacataaaatgtttgtttttcgaaacaggttgacctggaatgttccctataatccagtcatgccttgaatgtatgaactttctacctcagcagcctaaatgttgggattaaaagcatgtaccaaaatgcctggctgaaatttttgcttcctggtattgtgacacatgcctgtaatcctagcacttgggaggcagaaggaggtgagtggatctctgtgactttgtctatcctggtctatatagcaagtttcaggccagccagagatacatagtgaggtctcaaacaacaaacaaaaaaacccaaatataaaataaaaattcctttttctttcatcagattttgaagtctctatcacttcccctggagggttggggaacaactactctggaccatagagaaaagtcattttccatttctgtaaatgtgtctggtcatttttatcttttgtgattcaatttgtatttgttacagagctgtcacgtggatgctgagaattgaacctaggtcctctagaagtcagtgattttttttttttttttttttttttttttttttttttttttttccttgtggctttggaggctgtcttggaactagctctggtagaccaggctggtcttgaactcacaaagatccgcctgcctctgcctcccgagtgctgggattaaaggcgtgcaccaccaatgccccggcgaagtcagtgatcttaactgctgaactgtttctccagctccccattcaaaacttctaagaagcattgactctgcagtaagatatctctgtgattcaggtaccaacattatatagcctccatggaaagtggtgttacttttagggcctctgtcttatctttaggtacctggcaggcccgtggcttacttcaaggggctctttgtgaggcaccctgacattccttaccagcaacaggtgagtactcatgtcagggtctgatgtcagtgtaccccctgccgttccactgggatggttttgtatgtttattgagaaagagagtcctgtagcccagtctggtctcaagcttgctatgtagctttattggtcatcttgtccctgcctcctaagagctgggattatagacatatgccattatacctaccattcaagactgaaatgcaaggcctgcatctatgaaaactaaggatttgccagagaggatgccgaaaatgacttaagagttctggatcacagaagtcaagaacaattaattaaaaaaaaaaaaaaaagaaagaaagaaaagaaaagaaagaaaaaccaaacagtagagttggggaatttcattcagttggtggagtacttgccttgatccattaggccatgggttcagtccccaacacaggggaagaaaaaagagaagaaagaaaaaaagaacagtagctaagacaggtggctcatgcccataatctcaggacttgggaggctaaggtaggattgccacaaattcatggacaacctaggctacagagtgagattctgtctcaaaacaatctccccttcccaaactaaagacagctttctttctttctttctttctttctttctttctttctttctttctttctttctttatttcatagaattatttgtttattatgtatagtgttctgcctgcatgtatgcctgcatatcagctgagggcatcagatctagttatagatggttatgagtcaccacctggttgctgggaattgaacccaggacctttgtaagagcagccagtgctcttaacttctgagccatgtctccagccctaaagacagttttcaacaaagaatactggtaatgtaaagctgaggtcataaaagaaattattagaggcacagatggaagcactaggctttgagttgaagaggggtcacactgtcatagcagcctacttagattaatatcttggtagtgtaaatggagagttctatttttttgtgaagatgtgagagcccccaccaagacagagcagagaatgtggggtagaggtttaaagagcatggagaggtcaagtgtaatagtgagtgcctctaacccagcactcagaaggctgaggcacaggcttgagagttgagggcaacaaagggggataaaggagtagacagtatgtagaaaaaggtacttgacttcagaaaagaagctgggccatattcaggatttaaatgaggtgagatcatgagctttctagtgtgtgggtgtatgtttttgacacaggacctcatgtaactacctcaaactccctatgtagctaaggatccttaaactcttacctcttaactcactagtgcatctcacattacagatgtgtgctgccacacttagtgccaagggtgaatttaaaatgagaccaacctaaattctttattcttccagcagtgtttattgctcttgtgcacacaaacagaaaacacatatgctaatgaactgacaatgaacaaagcacaaaaccaagagaagaaagcacactgacctaacagaagagaggatggaggtaaagtcctctgtggctgtgatgaggacacttttattccacccttcattccaccccaccccaccccacctccaaagcatccaaggcccactgctaacctttagtagagctggaggctgaagcaggccgagaggatcgttttcgatgtccattttccacgctctcagaagccacagttggctcctcagttcgagagtttcttcggcttggggttttggacttctcaactatctcttttggctcactgctgacagagggaagtaccaagtttccaagaaggttaaggacatcaagacaaacaaaaagggactctttaagtacagtttcatctctaaagtaaaagataattagcagctattcagggccaggaatacggctcagtctatttagcatgtacaaatcctaggtttaatccccagcactgaaaacaacaaaataaaacatatcagtcattatagacagaaatgggacaatgctgtcaagaacttaaaagtgagtctagtttgttacattagaaaaataaaataggctggatggtgaggcacatgcctttaatctcagcactcaggaggcagaggcaggagtatctttgtgaattcaaaggcagcctggtctacagagcaagttccagaacagctagggctgttacacagagaaaccctgtcttgaaaaacaaaacaaaacaaacaaacaaacgaaagcacaatgctggtgggattgtggaaaagcaggtgatagaaataaagaactgcaatagttcctctaaaaaccctcatttctttccctaaggcaatatatcccttcaaacattattttgtaaaatttcaggtataaaatgtatttaatagatgtttaaaagtttctactagtcccaaataatatctaaaatctaggtatggcagcacacacctttaattccaacatttgaggggtagaggcatgctgatctctgtgagtttgagcctaggctggcctacatagtgagttctggttcagccagagctacatagagagaccctgtctcaaaagaaattattatttgggggggttactaggaaaatatgagcatatagtggtattaggtaatggcatacatagtacattttctaagtaataggaatacattcatcatccactgcagatatgctgaatgtcccaactgcaaccctggctttttagcaggcaaatattaaaaattggtaatactgttattaaagacacaggggcaaaaacattttcatatatttcttatggagtataaattgtataattcaaagattctcaataaggagcaactgtgatcagttagatgcattcccagccttggacacatttttgattgttgcagtttgggaagtgtgccattggtgtctttgggtaaacactctatggtacaaagggagacccttacaaataattatctgatccagaggtcagtaatgttgaggtgggaaaacttggtgacatcctctacctcatttctagtaactcctctatttctaggtgcctaaagaaatcaatcttaaaacatgtgtgtgtgtagggggtgggggggcattggcaagctggactcatactgcagtttagacgggcctggaacttggaatatgtagccaagtctggctttaacacaaggcaattctctgcctttgtttcctgagtgctgtgattatagttatgaatttctacaactcagtgtaaagaaattcttttacatagctttgattataaccaacaatgtaataaattatctaagtagtgggattatattcacaatccactgcagatataatgaatgtctcaactccaaccctggagcttaagtaggaaaatatttaatattggtagtaaagacaatttaaagacacagggacaaaggggctggagagatggcttagtagttaagagcattgactattcttctagaggacttgagttcaattcccagcaccatatggtctgtaactccagttccaggggatctggcatccacatacaagcagacaaaacaccaatacacataaaataaaaataaagttaaaaaagacacagagacaagtttacagaagacataaaaacaataataataataattagttacttaattttggcacatctatatgaagtcttaaaaaatattttgtgaaaggttactcagacaaattattcatgctacatgagtgaatgggtttgacacacacacacacacacacacatctggaacagcacccctctgtatattctttaaagaagactacaagatgactgcaattttctaatgttttctttcttttctttcttaaacacaaggtctcatgtagtctagactatcttcaaacttactacatagctgaggacgaccttgaactcttgattctctggcctgcatctcccaagtgcaggtgctggatttaattctgctgaaatctgaaaatttctgtaaaaaactttttactatatccatggttcaaaaatgcttattaatatcactttaaaaatcttattaaatttcattgcaagaatagaactgaaatgattacagaactgaaatatattgcaacagaacaaaacaactacaagtctgcttcttctggaaagatctccatgtccctctctagctgtggacttagcctttccttctcttaggttcacagtgtatacagatgacctcctaaaccatcttctggggttctattatatggagttttaaagaatttgtttatttatttatttatttatttgcaggggtattttgcctgtatgtatgtctgtgcacatgtgtgtgcagtggttctggaggccaggacaggatgttacagacagttatgagtcaccatatggctgctggcaattgaacccaggtcctctgaaagggcagtcaatgcccttagctgctgagccatctctccagctctggatgatctattttaatgttttgtgccttccatgagactgtgagccccttacaggtacaaatcacagtgtgataatcaactatcactactccactgctcactcctgccagaggactctttgccagtaacactacagttgggaactgagccataactgttcactcattaccttagctttatataaaaaagttacccatatcatatcaaaaactaagcaaattcagagaggccacactggagctagggtggaattacaagtaaacaggtttgtatctccttctagaggtttgaaggatggttttctgtttgagcccagaaaacagtccaattttctgaggataatccctatgtggaacccctttctcttgtcaaaacaaaacaaaatagccaaagcaacactacccttgtgtttgtgtggccaatgtataggcagttctgcaaacagacacctatgaactatatatcaacttgatagaccctttttatggacaggtggcatgtatttgaaaaactcaaatgaattcaagtattagttcatctcaaataaaaacagatgggcagagtggtgaataggaaaatcaaccaatttggcatcagggaggaactgtgcatttatcagttacaatatttaatgccttatcctctagagtctagacttttatctacaaatctccaacttgtctattgtaatataggtcaaatgtaagggccctggagccagaagagatgggtttgtacatcatatcaccatttgctataactgtgaccttgggcagtttagttaatggtttctgacctttagacttctcacctatatgatataatttattatcaaaacagatattgtgaaaaattgagaggtaatacatataacatgcttgtagtccagagtatggcaaggaataatattcagataatgttagttgatatgaagagctgacatgaagattcaatgagaaaatggtattttacaagttaaatttctatacaaatgagacattttaaaaaacgttactgcgttccttcactaaaaaagggagtgattctttctagagctaatgaggttgggccacagatgcacttcatctgttctgatgggttatatagggtagcacagttagcagacaaaagcacaggtttggggttacactctacctccctggcatcctctttataacctctgagtatcaaacagccatgcttagaagataattcaaggaccaccagtaaagaagctagtgtatatatatagaacacgtatttcttcacttgtgtttagtgccgaatatgtaatcagttttgaaaacaatggtaagacagaaacttagtcatctagtttaattaagtgaactgtcaccctggaggagtgagggctcacagaaactctctcctttgagcagtagaaacaggctggtgctagagtacaggagaaagacaaggtgaggagacggttcaagacagaagaagctcatgccatggtcatgttaagtctgcagatatggtcatctttcttacctttgtccagagactatgactgcatttgcctcaagttctgtaaaaaataaaaaggagagaatgagacgtggaagcagttgtaatatgtccacagggagtttctagtagtctaccaaatgctgtatttagactaacaagtctctacgtcctacaggagtctcacccaccctatgtggtatgaagacaatgttggcactgatccaacttggtttgttgacaatgtaagatactacttggtctatttttatttctagttcatactgtgaaataatcctgttgggatcaacagaactaaattcacactgcctggttcatatttcatccagataaaactagtttagtaaaagaagtctcttcctttcatgttaaaatatcaccaccttcctgcattttctttccaaaggcaattatctttaaatataatagtgtcttttaaagattcatttttcccctgaacaacattctcactcaattttagaggggagagagctatgctttgagatactacccaaagactatattatatttgtttctgagacatttcacagacttcatcagctgccaagtgatgtcacagaaacagccctctgtctgtgagggctgcatctgtgggcattctttgggaataccagacacttcttttcagcaccagcaaaaaaccaaaacaaaacaaatctacttctattatgtgcctctaggtagctccatctcttacaaagacccttccctagtataccaaacagccatgtctcctgccactggccttcccctggctctgtgcctgttttcccatgtagagaagtcagtgcctcatgttcaatatctaagctgcctgggggatctctttgaaggcagagtacctagcttaaatttttatctcagctctttttctttcttccttctccccttctcactttgtagcccatgctgctctggaattttctatgcagcccaggctggcctaaaactcaaggcaatcctcctgccttagcctaagtgctgggattatagggaatgagctgccatacccgccatatgtcattttttattatccatgtgtttatgtgcaaattatttgccttctcaggactcaatgcctcatatggaaagcagagttgactacgttatctgctttaatgttaagattaaattgaaataaaacatatgaattttagtatagtacctgttacttagtagtgactcaatattaactattattatttggtcactttgtacttttcctgagaagaggcaggacttcactgtcttcaatgcaaaattttggcagagggaatccttgcttcccgtcttctgcttagctcccagaatctctcccataagattgaagtaatgcctcaagaaacatactaatattaactccttcttgggtctctatttccctgctgggtaagctggagtacacaaattcacctaatatatgttcaataataaaaatggttcaaacaaaaagatgtgctaaccttgaagagttgccacccccaacttgccccaggcatcctattctttagcacaagttgcttggagctccatatttagcccactttggactcatattcataatccttctgtcccagcttcctgagtgctgggattctctatatgtgctacatctggctagtctgctctttaagtcttagtttttaactaattaattctgtttgtttttttgtgacagtctctctatgtagccgtggctgttctggagcttactatttgaggctcatagagatctgcctgccttgtgccaggataaaggtgtgtgtgaccagcccagcttgtgtactcttctgaaagatgacaaagaagttgattttgagaacttttacactaatttatttaagtggaaggttctgagggtgttatatttttatgtttttgagatagagtcccatgaggcccaggtggcatcgatcttattttgtagctaaggataacatttgaattcctaatcctcctatctctgcctcttgagtgctaggattagaagtgtatgctaccatacttggcttaaagagatcaatatatattaaactttaaaaaggaacaaagtcccctagcccattattctgataaaaaagaaaaacagtaatagcccattttctggagtgaagagcctgggcagcatcaacattacagacatggattggggagggactcatgaggctccacctctatcagattatggctactggaagggtgtgagggtcagtttagttcaatggtgtagtcactggtaagctattcatgctccaataaatggccacacacccatgctcatagcaagcaactcaaattaaacctagtgggtcattaaaagaaaggcacatgagagtaggaagagggaagtgggaggagacaagggaaggcaatgggaggttgtatgatcaaaatatattacaaacatatatgaaactgttaaagaatacatttgaaaaacatttggatcaggaaatggaacacctctcccatttctagttggtctttttgttaggaaaaaaaaaaagagtattaatatagcaccccttttcttaacaatttctctgttcccaaatgtgcagtacaatgttagttatcatgtaggcagttagaagcaagaggaaaatgtgatggccgatgagtgttttgtacatccattctttccacagtatgtaggaaagtaataaaggatatagaatcctgaagcaagttttaaaatacaaattatatcttatttttattggcttacattcacacaatcattttttcttaaaaatttggtcatgtgtatttctctctctctctctggttttttgagacagggtttctctgtgtagctttggagcctattctgcactcgatctgtagcccagggtggcctcgaacttgttatcctcctgcctctgccttctttagcaaatcctaccggtgttagccaccacaaccagctgtatactttcaataaaaggatttacttttttttttttttttaatgtgtgctcgtgtgtgcatttgacacttgcaatgtgcatgagggtgtccagaaaggaggccaaaaagacccctgatcccttggagctggagttacaggcatttatgaaccaccagatgtggttctcggaactgaactctggtcttctgaaagagcattaagtgctcttacctactgagccattagcccaagttcacactgtcaatgatattctgatttcctttgggaaccagctcctttcttttttgtattcttcaacaaccttctgtgaaccaagaaccaagtaaaactaaacatgtccacgatactcacctgctctgggtctaattggcaaaggcagaagttgttcctactgccatcaaattactcgtgtgttcagagctgatccagcatctcacagcagctattagattacacttgacttctccttccagaaacaccacccctagttctaaatacgagggctatttacaatatcttggttacagggagcaccttaaaatcatccagagatgattgggatgattcattgtaagcagaggggctccaatacacctctacatctgccaagataatctaactatattttggtgcattcatgcttgctaccctagtaagcaaccatataacaattggctggctgccagccaagggtagcagggtcatggaacaggggaaacaactcaaggtaggatgacagacagacaatgagcaaagagatgcctttcttgagctttctggctaacacaacaaatgtgaaaatgaacaagccagttgggaaaagtactacgcaagttctcccacccaactcaaactggcttggaaacaaataggtaagacagtcccaggtacttactggcatgagaacatgtgacactgaggacacactgattcctacacatgtaacccatctcactcaaagaagatactctagatagtgccttacctggtctggcaacaggcccctgcagtgctgtggctggagtctcctttgggactaaagtctgtgaaggggctgaggcaagaaacaaacaaataagtcttttacttttttttctaactaaaccagaaagcattaaccaagttactaagtccctgcagccaccatgttcttaaaaggcagtaccgtaacaaagcaactgaactaacactcagcaacaaggattgccactccagggtttgttcctcctttgtgcagatataaagaaccaggaaggggatggaatggcaacaatagtaaccacaatttcaggtcaggaccccccccttttttttttgttttcagacagggtcttactgagtttcctcagtttggtcttaaacttaaaaactgttttagtaagcaacctagctatttttagaatgaatataccaatcacctcaacatttgaaaacttctgacttacccctctagagactacactctccttgattaataaaacacacaattctgtacttttctacagcatctagcaaaggtaatagacataaaacagacaataaatttatatctaatgaataaatcaatacagtattatttacttttctaaaaaatagtttaaaaaactttctaggggcaagacactgtgccaggcaccctcagagattccatctttttgcacaccagaaattcagcctagtattgaagttaagtacatgtagtacactgcactctttatgttatatggaaagagacacataaaagtataaagtgccatggggatccaaagcaaaagaatattctaggctgaaaatgtaaaagaatgttaaagatagaaattagtctttgaaagacaggtatttaagaactagaatacacaatacattctagaatagaaccttcctggatcactcagtaaggatttaaggctcaggtttgccagatctgtcaaaggtgtggcctctcatcttaacaattcagcctaataaaacttatgacaaactacaagaataagttacaccctttggtggaaactaaattttgtagatttctctctgtttagtagtcaaaatttattttgcatgcttctctgatgaggcttaaagctgtaccttaacatctatttagcttaagattggtttcgcacattttcaagacaaaagcacagaagtcccttggaaaggaatagaaccaactattataaacaaagtaggtggtcttaattaaaactgaaccctttctaattgctagttcatctccctaaaggttacatgtttattattatttgtgatccaaataaaaattattttctagttacttcatcgttattctcttagtatcagagggacaagttccctgaatggtaacagaaatggaaatatttagtagcagagaatacacttacaccacactaatttcttctggtttagacaaggtcttgcatagcttagtttggcctcaaactcagtatgtagctgaggatggccctgctcttgatagtcctacctcctccccccaagtgctgtgattatatacatgcaccaccatgcccagctttctttaaaattcttatcaacaaaattcaaactggaaacactgtccagcagagtccctttctcctataaggattctttgcaggccttcactcttccctgtatctatctctaacattgaggtaagcaggggaaagaagggaaggaaggctaccagagctgtcagagccagcatgctggcacttgatagtcaaattccacttgatagtcaagttcccactgaatcctacatatcctgggaggcagaattacaatttccactttacaggtgaagttcatggaactcactaggttgtaactggcaaccaatggtgttaaaatttgaactctgatcataacctctatttctgttcctcctcctaattggcaggcactcaaagtattttagctgcataaataaaagagatattattagctggcttagatatgacagaggcctcccagctatgggtaccattaagactgacctgtctttaagaatgtggaacttctgcatcatttgagcctcaaaggagaaagaagctgtaaggacacttgtgcttccagtattaactccctctgcagtacacaggaaataacctgaactagacgtccattaatggaatttacaaagagatcatgtccaaaggaaatgggaaataacatatgaactgtgttttaggtcctgtgctaagcacatcacatgcattacctcactgaaatcttgtaactattattgtctccacattacaaaggaggaaagtgaaacttgccccagtccattgagctagcaaatgctggtacagttaccaactcaagcctatctgactcttcacaacttagatcacgaaacctggttttctggtaagcttttttggagcagcccaaacagaaaggtccttgaattagtatgagaacaaggcaaagagaacaagtaagtcttcatgatgagaagtcgctgtgtacacccaagggaccatgccaggctggagacttacagtataggctcaataaatagtaaacatttctgagcttcaatctttttacccagaggaaggagtaagtttacatcacatgactggtataagatgatgtgagatagtgtgtatgaaaatgcttttacacacacacacacacacacacacacacacacacacacacacacacacacacacacacacgaaaatgaaacacgtcatcagttcagaagctaggaaggaaccatgttaatgaatataaactgaatatgggatttaaaagcatatttttcaatgtactttcagtaagtaaatctacaactatggccatttttcttcctctaagcagaaaagggctcatgctttctcttttgtgggacaggtcaacaaaaccctgacctgaggagctgatgccaagctcaagtacatacctatgctgggtagaagctctggatgaggtcccaccttctcttccactaggccacctgcaagtggctcagatgctacgccaccatgattgccttttgtggttggcgctgtggagatgagctcagagggtaccagtgtggttactattgagcgtacactggttgggagagcaccgccaggtaagatgggtcctgttgaggtggagcttgggcccatggggctagaggtcatttttagtagcgtgggtgctgagggtgttggggttttactgtccagctctgtggagcactgctctgttcccattagcccaggagttgtggtctctagccctgggccttcagtctctccatctgcaccatactgttcttcccctttttccagagagcctgtaactttcttacaagccttggtcagcaaaatctggccaattttgtccacttttcctttgcccttagtggatgagaccgggcttcgccgattggcagaggagcctggactattggtcaaaaggggagaaactactgtggtggactgtgaagagagcagagtgctctgatctgctgaggtgttcatctgaggactagcctcatctggatttaattcttttacttgctggatagaagaattaggagcgacgactggagaggatgtacaaggaggggaaggcagctgaacaggagtggcacgtgagctaaggaccaacggccggcctgtctgtatgtttggagcaggactgctggagggaacattaggtgctacaggagctgaagaaaattttatgttttgaggtatgtgtaaaggtccaacaactgcgacggagggaggcatcaggccactgttggttgtcaatggggttgcaggaattgtgcttggctgtgatcctttcataacctgaataattgaagatgaattgataaagacaggtgtaatgaactgaggccgggcattagattgagcagcggactgtccctcagaaaccataactttgttacccacgttgggcattgtgacaactgttgacatcaaggcagaatgcaagtttgttggcagggctgctgatgtgttagatgaagtggttatgggattggaagtaacaaatacagttatttggtttgggggcaaaggagtagaaatggaggaagagctgacaggccttgacattactggagggatgcttggtgcaacattagagctgacctcactcaattctggatgcgcaagggttgaacacggctcattactgtgaggtaagtttaaggaattagagggctctttagaaggcggatcctgcagtgtgggaatgacagatgcttttttgaggtcttcccctgaaactactggaggtgctacttccagatctgtaagcccagggggtttaatggtcacattaggagctccagagttgtcaagaagttggcttaatgatgttggtgcttctctcatggcaggagacatcaaatttttgttctcttcaacactggggagtttgttagcatccaaaggttgcccatcttttttggactgatcttcagggacaaccattttagcttcttggatagggactactttcagctcaacatttacctgctccttcctaccctgggaattctggcaatcattgtcctgaggaacgttcaaactctctttgttatcctcaagaacagcccccactgcaggcacaggcacaggcacgctgggattctgaggattaagcccactattgttaggaaagcttccagataaagtgggattagcaattggagtgggggagaccaatacatttctaggcagttccatgttctgcaacagggttgtgcttggttgagaagccagagtaagttttggggcttttgaattttgccttccaggacttggggtagttttcctactggaccctggactagacctgcgactgttacttggacttgcccgttttgttgttccaggattagactgttttccagaattcaccaccacagaatctaatttatgagcttgtggggcagcaaagttaggaggattatttatggtaagatttgaaggtgcttgcccgatggctttcagagttgttggatttaaaccctgttgatcaaagcccctatttaaatttggcctgggaggtaaaggaatattaatctgtggagggaagagtcctgctatggaggcattgagtctttctggtgacagacttatttctgaaggttctgtactgggagggcggttgttgggtgtctgaggataatagggtctggggctggctctgtttggagttttaggcctagatgtctgggttggtgcagcaacatttggaaagtggtggccatgggagctaggcaaagaatttacaggaggttgctggggagttgcaccttgagttgctgaaaggggagatggtccaggtttgggccctgtcatcattaactgattctgagaaactactaaatgtgacggcatgttatttgggcctcctgaaacagatggtacttcattgccactagcttcaggaagtgaggacaactctgctagtggagagctagaagaattctgtgggttctcctggtataccattttcctcgaattacttcccaatggagtattcacagacattgggattctttgtttatcaggtgatggtggcacagaggcaggtccttgcaagctaaccataacaggtacattgccactctgctgcacgggcattctctgggagtctgggttcagaggaccccgtggagggtggacattttgggagactggaagcctaatggatttagggtcttgctgcatcatgagcatcatcatcatttgttgctgctgctgctgatgttgctgagactgtggctgactaggtggtggtggtggctgttgctgctgctgctgaggcagttgtggttgtggctgctgctgtggtggctgtggtgggggtgccacatgctgcatgagttgaggaggcatctgttgcagtggcctctgttcaactggttgagtaggataacctaaaacaagccccccaaaatcagggaagttagatttttcagcaagaaaactttgctacctttagagtgtagctaagcagtactcataggtagcagactgcgcacaaacagctcaggcatgctgttcccattgtctgacacaagcaagggttcacactgcttaaggaggcaaaaagcaaagcattaagaacacgaagccccttggtgtttacgttgtgaatgaagcattactgcattaagactgtattatgcactataaatgagaaaaaccctatcaacagcaaagggctggttgcccagtatttaggtctcaggtagaaataatcagtaattcactgtgtgtatgaaataacatatttagaaatcgatttttctcgtagcagaggacttgtttttctcaaaatttggttttgatgaaaacagcctttttgttcctttaataaaagtaaaagatataattctagtattgagtccacgatctccatatactatgctgtatcctttgggctccatcctctgggggaaactgaatgtactgtattgcccccaggttgcaacagtttactaaagagagcagtaggtaggggctgattattatgttgaaataaaatgaagcactaaagtttttatgcatattcaactctatttactttcgtatataaaaatctttatttggaaaagtatttttcatgaatccacaattggagaataaataagtcagaagcatagacctcaggattaaaaaataatttggggacaagaactttgagaaacaatgccttctagatttgcagaagacaacatctatatgattcttttgtgatggtttacttgaaatttctgaatgaaaatcttatacaatcagtataaagagaaggaagattcaattaaaccaagaataaaggtggttcagtgtgggaacgtgggcacatgttggggatgtgattccataattatatttattccattgttgcatgaaaaataatttggaaggtttccagaaagtataagacatgaataactggctctggcagctggtagaaattctgggccaagattttctcagagctaccaaatgctttggtcagactctgatcaacagagtcactgtcttctagtcaaagatttccatggtaccaatgggcaggatccagttctgaagttgttttttattttatttatttttttgtcttgttttttggtgacagggtcccaagtatcccaggatgaccttaaactcattatgtagctgagtatgatcttgaactgctaaccctcctgcctccaccctgcagaatatagacaggcgtgtgccaccacacctggctcaattttgaagattttctttaaaactttttttttttttttttggttttgttatgttttaggcccgagtaacttcttgacatttataaatctggcattccaacagatcaaacacaatgggttcctatatagtctggggttcctacattaagaaaattgtaatttctgaagaagttcgtttgtgtcagggctataacacagatgcttctcatctttaaaatgagtttatcagacagcacagtaaataccaaagatagcaatagagatgacatggcagcctctcaaaagtcagagctaaaggcttaaagggcccaaaagctagaggaaatagccccagggagcttagtgatagtaaggcagattggggttgagagggaaagtcaggtacacacatgccccataacacaatcaataactatatttgttagtcaaggcatacaaagccttgatgcctttaggggccaggcggcagtaaagacgagaagttaggctgcataaaccagcagggtcctatggacactgcccaactgcagagcaatcgcctgtttctaacatcaaacgaaggttatttgtttagacaccaatagcaattcaaattcattaaaggccaaattcagcttgcaggtttccagtttgcagaaaggaggaaataaatgtctgaaggaattctggaatccacacaagagttcagatatgcctgatgggacgtacctttctgttcacaatgtcttctgaacatactcactaaggactagagactacctagcttcaacagtgctgctgtggctcactagtgacaactgtagtatgctaaacaatttgtaataagtaacatctagtcttgacatcatgatagatgtcctttgaaaaaatatgattaaacgtagattaaaggttagcctgaaaaatattatcacttttaatatgccaaaaaggaggtgaaattactcaggagaaagaaacaaagcattaactcttttcccccctttggttttatgagacaaggtttctctgtgtatccctggttgttctggaactctttttttgtagttcaggcctgccaaattaactctttacattcataggagagagcttgtgaaactttgttattctggaataaacttatgtcattgtttaggccaagaaaaaaacaagtatagagatattgtggtatctggttttggttccgtaatacctgggttgagaagaatgaattttaggttttcatcctttaacatttaaaagaaaacattctataatcaaagaagaggcttcaatactactggcactattcatttatgagctgctattaagctgacaatagtcacacgggcatgtattttgctatttttcatattctgcttatgttttaaagaatcacaataaaaattttattaaaaaagtcatcttgttttaaatcctggtaatagctctctgctttgagaaagtcaaaggaagtaagaattgcaggcaagcaggatatagtgaaaagttgtctatgttattatattttattctgatgccaactggaactacaatgctgatcaaaaaaaggcactttccattcagtttgatttgaggatttataatgaagccaattaagcaggtgtgcatttacatgtgaatttacatgtgtgcccacagaagttatactcgaattacttacttaaataccaatgcagagcttaaagttcagaagcagactagttagtaggcaaagcactgttgtttccttgatgagaaagaagccttgtaaaggtatatatgcaatgcaaagcatgtgattttagctaatattttattacctggtggccggtttgaaaattctggaagtttagggcctgtgttgtccaaattgattccttgttctccaggtaatgactgttgatcagcttcctctagaccagccggacgattatcttgggtgctaaaagtagcacaaatcaagtaagttgtataagtaatacatgaacctagctcaacctcttcctacctacaactacaatatgtttacatatcattcttatcataatctttctagtctggatactcaatattgacctaagagtaaactagccatttcattaacccttaaaatttacttactcttagcattgtacttaaacagtgtttccctctaattcctgacacaatgtttcatataatgacacacttttaggtgtttcaatgactgatgaggagtttgagctaccaatatcctgaagtgctattcctgcaaaacaagtattcagtgtggccattaacttaaaaccaggtgccaatgactcaacagctgtaaggtagaactggtaaaaacagtattcagaagaaaggtggagaataccacaacaaagttactaagctttgctatagaaggaagacttatcgacataaccactggaattagaattctttttgtaacttagaattttagctggaaaggaaaaaaatgaaaatgtttttcctgctaacatccactttattcatttatttatttatttatttatttatttatttatttatttatacagcgtttctctgtgtagccctggctgtcccggaacttcctctgtagaccagcaggctggtctcgaactcacagagatctatctacttctgccttccaagtgctgggattaaaggtgtgtgtcaccactgcctggcttaagatccatatagtgtttacattcttttttaaaaaatattttttaaaagaattatttatttattatgtatacagtgtggtttctgggaattgaactcaggacctctagaagaccagttaatgctcttaacctctgagccacttctccagcctgtgcttacattcttcatttggtttgtttcttattcccagttgtacctttctttccttccttagtttcctttgatctgattacagtcatccacttttagatagtattttgtcccattacactctatattgttttataaaccacacaatgcctttaacagcagcagcagcagcagcagcagcagcaacagggctggaaggatggctcagaggtcatgagcactggccgttcttccagaggatccaggttcaatttccagcacacccatagtgtaattacaccaccggtcactccagatccaggagaccagacatccttttctggcctctggtggcaccagacactcatgcattggtgcacagacatacacaaagccaaactacccatacatataaaaaaatagaagcagagggaaaagccccaaaactaacagcatgttagcaggtcctaagcacaaccaaatcgctgtgccactcggttcctatttcagagcacgaagaaggagtttgtggtattcttcacttaaaaaaagaaaaaactatatctaaaacaaagaaagaaacaaaatccacccaaattcagttatctgctccagtccccctcttgttatggataagaaaacaaaagccgtaagtgtataaaacaggtttcacagtaagctaacagcaggactggaggtaggttaccttcctattaatcctactgtctctctttcctaggaacccggatgctgtgcaaggtccttttaaaaggatgttgaataaacagttaagatctcttaggagaaagttgatgatgacagcaaatgaataaccgaaatttaactcccagcctattagagggaataaaatatctaccaccataaaaaaaaaagttaactggacaggttggtaacagcaggaatttaactgaggatcaggtataagaaaaatgaggtagagtatttaagtctaattcatgaaaatatatgttgttaacacaaaatgactggcttttaatatttaagactcaagaagcagcaagttactataacaggttaaaaccaaagaatgctataggcttggctaaaggagctggctttagtttgaacatttaagcttatttaaacaaagcacccttgtttgagttttctctctgtctgtctctggtctttacattcccagcctttcccccttctctgcaaggtctcactatgctagcttcctcggtgttgagagaacaagtgtgagttgccatacttggtgtagcaatttgtctaagactgtttcatgctcattagtcaccgggccctgttggtaatgtctctgaactccagttttatgactaaaggctgaaaatccacctcaaacaatattccttcaggaaacatttagtaaagtcagaaacataactgagtatgtagttttaggatatgcaatgtaattgtcaattagccttcctattgtgtcttatgaaagagctcctctgcggaacttgtactgaaaaggaaactgatttaacaggaccaatcatgggtttaagtttttagggacaatgagggacttttagagaaaaggcacagatgcaaatgaataaatatttttttttcatttgtaagatggcagggtgtctccatgaatacatattgtctcacaaattccccaagagccaagataacattgaagtctgagccctgtggaatgacagtgggtagccctggtcacttttcaggttgatagatacaattcccattgagactacagaattaaaaggcctatcagccaactgtaaggtactgattttgtctgaatccttaaacaaataaactaaaaagaaaaaagaaatagaaaaatgttaacactattcggaaactattaagtagcaatttttgggtggtggtggcgaacacctttagttacagcagttgggaggcacaggcagttgggctctgagtttgaggccagcctggtctacagatcgaattctgggatatccagggctacaacagagaaaccctgtctcaaacaaaaaatttttttctaggcatgttaatgttattttgtggttatataagagaactatctttatcattcagagtggcactgatatatttacaaagcaaatttaccttaaagtaaataaaaagatcatagaaaagagtacagatgaagataagataaactataagctgatagttgttagacaatctcactgtactatcctaaatttagagaaaggtttcatgtagtccaggttacaggagtctaccaccatggctggtttatgcccagattttgtgcatagtagacagacactctactgagccacattccccaactctaattttaaatatgtttaaaaatttctatcaacaaatgtctagacagaaataaatgagcaatattcaaggttaactgattataacctactttagatcttgctgacaatttttcttcttccgaggcggtttcttcttcttcggtttatttgcattcgtattattttgtttattgtttacaccaaaatggcctgcagaaatgtcactttgcagtaagttgaccaacaatggacttgttagtgttacatccttattgactgggaagcctggattttgaccacaagacatctgatttccattgggtgcaccactgaatggtgcattgaaagacatcccatggcctgagaagtggtttcccgaagcactgtttccctgcatgctctgcacatgtggggggaccatgttggtttgttgcatgctaacatcaggcaacatctgagacaagttgacatcattatttgctgtagtagcaggatcaccatgctgctgggccatgtgtgggctgggtcctgggggccgcagaacctgcccctgaatccccataacctgagatggactgctgtttacaggcccttgctgggatagcatctgtcctgacatctgtcctgtaaattgcaccatgtttccttgcatgttcggagttggtcccctcattatctgtgctggtcccggcatgacattggattggttctgagtgttaaattgctgcttattcccctgcatctgattggtcattatttgctctatcattgggttctgttggagcaaaacttgcccctgaggccccatcatctggttatgtggtgccatcatttgttggccctgctggggaagcatctgcttgggtggggtcatcctttggggtgaaggcccaagattttggttctgagggttcaccatcatctggccctgtggcataagctgggcccttgaaaggatcatagggttctgagggttcaaagttccttgttgctggaccatttggccctgagagggtacaatctgttggtgcatgcccatcagctgagatggtgggccctgttgaggctggccttgcatgttgcccagggtcacctgaggaaccccagagctaccagcctgctggttgtttatgttgccatgaattcccatgaggctggattgcatcatatttggtggcccgtgagacacctgcatctggttttgaggagggccagctccttgaccaccttaaacaaaaacaaagaatgaaacatcatcatcatattactaagatactcaaactaccttactcagaaagacatccatcatccatgtatctaataatcaacacaaatgtactgtttgacacattttctgtgtggtattttgactctggaagtgtgacataggatggaagtaactgcttatatatttcatgatcatacagcaggagaaatgtatctttacttttatatagtaacttaaagataacattagaaagtaagtttaggagctggagaaatggctcagaggataaaagcactcactgcctgctcttccagaggtcctgagctcaattcccagcaaccacatggtggctcacaaccatctgtaatgagatctggtgccctctctgatctgcaggtatacatgtagccagaacactgtatacataataaataaataaatctttaagaaaaaaaaaaggaaagtaaagtttacttttaaattaaatgaagcattaccactgttgtaactattttattcacaataatgtagttataagccttaacaaaaaccatcatgggctaaaaatgagctttattatgagtaagtgagagaaacaaagaatgtaccagtgtcttccagaaaaaaactcaggaatactgtaaagacatttaaaaaatgcttcttgggaaagtaattatgcttttcaaaaactatgtgtgtgaaatctagatgttgtactttaaagaagataatatacaatatttcctaacacgaggttttctgctgaaatgacaaacttctgatctggtagctgtggacaggagatgttaaaagtttagtgatcctactctgtggcagtcccttgtggaccacaggggacatgttctaagttctctttaaaataggtcttggcctattgcattgtttgtttgttggatccttgggattttcttatagctacctgctttatgcctacatctcactggtggtgatggagactgaacccagggcctccaatgtgttcaattagagctatacccccaatctaatctaccccacagttcacctgagtaaaccttcagagcactatatagcaggttgctctgaaacaatgtgatccaagctgcctttaactattacgtttggcttaaaattttttcagctgggcacagtggctccatgcttgtaatcctagcacctgagcggctgaggcaagagaactgtcataagttcaaggctagcctgggctacatagtaaaatcctttatcaaaacaccaaaaataaaaacaaaggccacttacatgctgggcaacaactctactattgagctatatatccactgaactcatgctcgtaaccactgaactatctctccagccccaagaattaggaactttatacatttttaaatctcctataacattaactcacataactcagaaatgcagttttacattggcagacaggaaaaatcaaatcatctgtcctactcttctctcatccttcaagagacagtatttactttttatttattaagtccaatttttttctcattctcttttcttttctgagacagggtctctccatgtagtcttggctgtcctggaactatgttggctaaggtggccttgaactccgagatcctcccacctttgcaccccacgtgctaagattaaaggcatgtgccactgtgcctagcctcattattttaaaaagaataaaaaaaaattaatgcatatgtatctgtgtgaatgcatgacacattcatgtccatggagccagaggagggtgtcagatttcccgaagccagaaatacaggaggttgtgagccactgacacggacaatgagaattaagagagtagaaagcctttttaaacactgagtcatctctctagtcccttgttctttatttcttagaaaattgaatttttatttatttattattattactgtatgtgatgtgtgtgtaggcatatatatgcccattggcaaggaaggccagaaagagaactttaacctgctgagacatctcgaaggctctataacttttctcattctttaagtaatttacaatgaaagttggaattcagaaaaatttaagctaatttagttcaaactacttcaatgagaaagggcaaaaaattacttagttcctaaacaaccagaagaacccagaaacatgaaatttgggcttacaaaactgcttcaaggagtacttgttagctaatccactgtatgttatttcctgtccaaactttcttatatatactatactattggtactgactgaattggaaaagtgccacattgcataccagaatttagatactcagcatgaatgaagctgatatgtactatccagagattttaaaagttgcagatgttcaaacatgccataaacccatataactgtgaatttatggcttcctttcccagaaatgcctttttcctgagcaagttctaatctaagggtcagcaaatcaggcctacgattggtttgaaaacaggcaaggatttggaacactgttgtcctcactaagtagagttgaataactgcaatacagactaaatgacctaagctatttactatttagccctttatagaaagaagaggaagtatgtgtgtgtgagcgcgtgttcatgcatgtgtatgactcctgctctaactgaagtttcattttttttctcctaaggtgtttcctggttcttgaaaaaaactaaacaaaacaaaacttattttctgttatttcccaaagattatctacgtgtgaggaaattaaaggatttgttcatctgtatacctctattgtctatcaaagtatttaccacataatcaatgctcaataaatgtggctaattaaatcaaaataaacaaacctccatgctggacattttgatttgcttgcagttgaagggctcctgaattcccaggggtggttgctgtggtggaaggcacctgaccttgcataaagttcggattggcctgtcctgctgagaagccaggtgggaggcgtttaggcattccttaatagaaaacaatgagtgaggcagttacctagcaaatttatactcctgctgagatggaatgaataaggaaggatgagctgcatgaagtttccactggcttagctctctctgtcacactggtaggatctttaataataaggttgggaaagatggttaaaaaaatcaatacaatcccttacatgagcattgtcaaaatgaaaaagaaatactaaaaaatttccactcagaacatgccaaggaaaagatggcaatttgctccctacatgtgatctgaggccataccatagtaaggtttgagggctcacttttctctgtaataacaatgactcccagtatttatatattgcaacacaggcaccaaaagattatgctaaattctctcatgttcaaacaaattggtatgaaatagtataaagaaagagttgggtcccaattaaggatagatgggtgatgtattttcccccctttgaggaaaatgaatgacaatcgttgcagaaaaatctccctcccccaccagcgttgtgcttatctctttggaagagacaagagttcacaggagcttcaaagtgaggctgcattaaacttatgcctttctcttgtaagatttgctgtgattctgatagctatggtaccaaaaatcatgctctaatgtaatcctactcaagtttacaaccttttggaaggcctaatttcagaaaacaagtttgcagtaaagagaatctcagatccactcatgtgcataccgcaggtcttgatgtggtgagaccacctaggctctataaaagcaacaatacctaaagctctctcaaatttgttcattagggccagattttcaataccctgaaaaactctttgtagacaaatatgcatttgtcctttcattacagcaacaagtccccatttatatgctttcgttgtaattaagtcagtaatcatatctgcagaagggactacccagattctactgatctagggctagatgcccggaatagtgaagtttggagcagaaacattcttacattttctaaaaatgtcttagaattgaaatattagagcctgtatttcaacaaaatcaattataagagagtgaaaggactgatgggcaacttaactttaccagaaaccatgggagcatgcctttgctatgttgcattgaagatgcaagggtttttttctgggtaggcaatgggtgtctttttggggggatagtcttatcaggtgagttttactgacactctctatgccttactgaaaagctccaagcacagtcatgtgcactaggtcaatgattaataagaataaataataaacatggagatggataagttttactgtaatcgttttacctctcacacattaagctccattgctttttcttcatacaagaggcaccttacaaaataaataaataaatctcctttaggtataactagtggaattccctctctaaggagcaggcattggcattataaaactataaaagtaatgatttttgaacttagtcccctttaatactttaatcaaacttaacaaataccatgcttagattttagtaactaggattatcaaaattggtaagtagaagggcattttccccataaaaccctgtacttatcttttcatttttgctcaactgtataaaaatcttaatccttcaacaaatgagaagtttaaattattaataaaatacatgttttggtctggacattttaatttactagtacatgattaagcaaaaatagtttgaaacaaaatgaacatctctattttgaattttacctgcatgtttatccagagagctagcttatatttaaccagtaagatgttacatagtaatctagataaaaatacattaagttaactaagttttatatcaagtgtcatcaccatattacaaaaccaaacgattacatccttatttcagtcccaccattaacactaaaacctgacattctattcaaatctagcttcactaaatttaccaacacaagtaacttcagtgttcctcacctcctaggcctgggtgtaaactctgtggcccctggtttggtggctgctgctgcatcaccatgaagttaggtggcacatttccctgttgaaccataggattccgacctggagagctgacaggctgctgaaatccctggggaattgggttattttgaggtggccttggtcccatctgctgttgagtttggttaaccgttggggaggatgcaggggatccctgctggaaggaggagggtgaggaggcaggagacttgttggtgaggtggggttgttgcaggggggttgggaccctggagggtcctccctgcaagctcttcatctgaggagctgtgaactggcctgggttgctcatttgaggaaagtttgtatgggcttgtgaggcttgctggctgccaaagggataaggagggggagggtgagaaggtgtctgtaccgtggctaaggaaggtcttgcctgaagttgttgttgcattgggctaggcaaaggagccttcttccacccttgatttgcagtcattgtgcccagagagccctgggctggtggaggctgtagggctccagaaggcagctggttccagcctggaggaacaggcacctgagttggagcagtaaactgtggacgaatcccctgtggctgttgctgctgatgttgctgtggaggtcttgtctgcaactgttgttgctgctgctgctgctgctgctgttgctgctgctgctgctgctgcagctggggaaaattagctgggttcatttgtctgttcccaggaacaggctgcattgggtgatgtgctggaggtaaggatcctgagggatgactctgttgttgaatatggagtccagagagaaggggatccattgcatctgtttaaagatagtcaacagcaattaacctttgcaactcacatcatagcacactggcttggatctgctggtagcactgatattaccatgtgcttgagtatcttctaagaacaaacagaataccaacagatataaagatggatcctgccttaaagacagcttatggttcattgggatggtgaggcacatcaaacataaaatgtagacaacattttcaaaattgtattctgggcaattactgttaaaggaaaacaaaataaaatagtcaactatatttgtgaaatgctagacctaatgatttcagacaagtttttctttccttccttccgttctttatgtatgtatacagtgttctgcctgcaagtaaacctacaggccagaagagggcacaagatctcataacggatggttgggagccaccatgtggttcctgggaatttaactcaggtcctctggaagagcagccactgctcttaaccgctgagcatctctccagtccctacaagtttcctttttactgtaggaagcttagtgcttccaacatgttaatttatgaaacatttaccaaattcatatggcttcaaagttctgttatgatgtatctcataaaactaagcatgccaaggatatgtggcagtctgaatgaatggcccccaaggctcaaacagaggggcacaattaggaggtgtggccttgttggaggaagggtgtcactaggggtgggctttgaggtttcaagtgctcaagccaggccctgtgtcactctctcttcctgctgcctgctgattcagatggagaactctcagctacttctctagcactatgtctacctgccatgatgataatggactaaacccctgaacctgtaagcaagccccaattaaatgtcttcctttataggagttgctgtggtcatggtgtctcttcagagcaacagaaaccctaaaacagcatacttcttgggaatattggggcatagctgataagaaagtaagaaattctgagaagaaatgttgacatttagctgtgaaaattcatagtagattttgtaaagaaggtaaaaaatagaactaagcaattagaaattcagcatcagtgattaaatcccaatgatatctgtaagaagctccagcctctctgactgcagtgtgactacctgagtgagaagcagggcgaggagtcctgggctgcagttctggactggggcctggggccatcatggaagatgacatgttcccaccctggggcatcataacagtggcagggctcgccatccttattagtcctagaagaaaaaaagtactagaataacatactgaagttggcacatttgtgtgtgtgtatgggtggtgcttgtttctgagatgagatcttaactctaatgaccagactggtcggcacctcatggtaattgcttctggaagggctgagattataggtgagtcaccacactcagcttacaatttttatttttaatgatatattttagaaattctaaaagatacaaaaatttcttttaataactttttagatttaaaaactttatgtctatgaatgttttgcctgcatatacatatgtgtgcactacacacaagcctgttgtttgtggagaccagaagaggagttggatctcctggaactagagttacagatggttgagatagggtctcattatatagccttggctggcccaactgctacatacaccaggttggcctcacactcatagagatccacctgcttgccttctgagtgccctttttctcaattcttaagtcaaattcttagctcattaattttgtattgatgttcaccactgatacccgagagctttccttccaacttctataatggacatatttctcaaaatttgattgatacataatatccttactctaaatttccaagcacttttcaatttccatctaattaccctttaaaatcataagccatttagaatgtatttctaaatttttaaagatatgggtgttttggttatgtgctatttattttgccaaccacttaagtacactatggctagatagggtactgttccatggtatttactaaaacttgcttttgaaaacatttataatcatctcatataaatccacttatgcttgaaaagattaaaaactctggaattaggtttacatattttctatacatattcattcatatgaagttttttttggagataatgttgccatgactgaatggccttgaattcacagagatccagctgcttcctaagcactgaaattaaaggtatatgccaccaggcctggttcattatataaaatttttcatcatgtcattcaagctttcttcatttttataagtttgattcatcaattactaacagatgttaaaatctccaagacttgacatttcagtattatttttatatattcagaggctaggttattaggtgtgtaaaaatttagctatttttgatgaatttttttctgttatatggtctttttcatttatgatttttatcttttattgttattatttgtggtattagggatagaaatgaagtctttgcatatgctagataagcacttgagcaccaagctacatgtgtgactttttacattctgggacagaatataaattactctaataggcctccaatctggaatgtagtctcctcaggccttgaacttaaagtcctcctaagtaggtagaattacaggcaagtactactatgccaagattatatcctttactttttgagacagggtctcactatccatcccttgctgtcctggaacttgctttatagaccaggctaacttcaaactcattgagactcattgcctgcctcagcctccccagtgctacgattaaaggtatgtaccccatgcacgtgtttatccttttcatcttagcatctgtcttgtctaattaaaaaaaatactttttcctgctaatatttacctggcttaatattatattgtattctcatattttatgcattctcatattttctacagttctccaaacagtacagagctaaatctgagactattattctaagtaatcacttccatattaatagtgttctcaatccatttacctttactgtcagttactggtatattctgatttatcattcattctatgacttctatttataatattttctccctatgctatactgttttattttccctacattttattggattttttcatcatacctttcctttttaccattctattacttgcttcaagttgtacattctattattttactactatctttaaagtattaatcagcaaacctgacctagaatgtaacaactatatgcttgtcattactaagtcggccttacgccggctctggtggcgcaggccggaaggatttgctgaaggagtcagaggccggtggatctggagttcgactaagttggtcttacaaccaactacctgtctttatcaaacatcagctcactattccttcttagacctcccttcttcctgaagttcatccttgagcaggtcaattagcaaagatgtgttaatggtaaatgttccttcccccccaccccaaagaataaactttatttggcttatgagccaaacaaactttctcctgcacagttttggttccatgcagccacccagtctagaaggcagcaataagatccactttgcacccagcaggggcacctcttcagatagtggagggtttgccaatgtgctggtagttacacccttcaaaggaatgctccaaaagactatggccatatcccatatacatgaccaccagttctttgccttttacttgtggtatgcacagtctgcctttaagataggtttgtaacttggccgggtggtggtggcacaggcctttagtcccagcacttgggaggcagaagcaggtggatctctgagtttgaggccagcctggtctacagagcaacagagaaaccctgtttcgagaagaaaagaaagaaagaagaaagaaagaaagaaagaaagaaagaaagaaagaaagaaagaaaggaaagaaggaagagaaaggaagaaagaaagaaagccatgccaacaacagctttgttggtctggaaaatgaccttcttggatcctgaaggcaaattcacatgggtcttggtaactgggttgtgggaaatgaatgttacatagttcccagaggccagcactagcttgtccttgtccccaggcttcttctccagaaaacatgtaatagtacccacaggcctggtgcccactggtaaaacattgccaatattgagctggaccttcttgtcacagtacacagatgtctggtgtggattacctctgcagcgaagcttcttaaatggataggaatcacaaaggacaaccttcacaagaggagtgccatggacaaggtcatcaatgacctttcagatgccctcaatatagccgtactgctcagcaaagttcacagtatgcaagtatgaggcacaaagtttcttctgccctctatcagcccatggcggcgggtctgctagaagcacagctggtaatgctcttaagtttctgaaaatttattttgttctacttctcttgatagtgcaactagatttagagttctaggttcccaatgatttccttagcatttggaaatactattctaagactctggctttcaatgttccagctgagaaatcagctgtgaatctgatagtctttcctttgtaagcaatggctcttctggggtgtgtatgaggtgcctttaacattctgttttccacgttctgtatgtttacagtacagtttagatgtacatttatctgtgatgctcggtatttctgatattctgatatggaagaattgtgtcattttgaaaactattctggaaaattttcaggtattctttaatgcttgttcctcagtttcttcatcttctggagctcttttaaaattttttcttgttttatccttcaagtctcgtgactactttcatatttccactatttctcttttctgtattctgggtgatttcttcaaattctccttcaagtacaactatttcttaattttctgactaaatcattcatttgttgccattaaattttttacaagttctgttcccccttcaaacatatttgagacagggtctctctgtgtaacagtcctggctgtcctgaaacttgctttgtagaccaggctggccttgaactcacagagatctgcctgcctctgcctaccaagagctgagattaaaggtgtgtgccatcaccacctggcctgttaatatatttttcttatggttttcataattttaaacatgctgtcactattacctaaaattccaaaaactggaagtttaaccctaaaattcattaacttaccccaaacttgtttgttacagtgagttttaactgaagtccataatggcccagtggagaatgtgttcctccagagcatcagtggcttcaccagtctagaaccacttaatgttaatgacaggttagctgttcaggtcattttattaacatatgtccaacaggcaaatggttaaagaagatattccctgaacaaccagcctccaagcagagccaatgtcaagaaaggcaaacacccaggtatctgactgtgtcaaaggtaactaacatttttagcctagaaaatctggcttcatgaaggattttgaattctaacttcattcttcatgtagccttcctgccacccaaatcacttggctcttcagattctccgtgattgtttttatgttttgccccttcctcctcccccacttcaaagacatggtcttaacatgaaggtcagactggtcttgacatggtcctgactgctgagatcacaaagtcttatgcttccacaccagctggtcatcactatttaaattttcatttttaacggattgttttctctgcaaagttcttttgcttgcttaaaatctcagctatgcattacatattatatcttatgtagaacttttaggaattttctaattagagaacacaaccagaaaaagagttacctgttaaaattagatctacttctgtagaatcccaccccattttcaaagaggacaattaggaagaacactctcaggaaacaggtatggtgatacacacttgaaaccccaacaatcagaagacaaaggcagaaggatagctgcaagttcaaggctagcctgatctacatagtaagttccaggttagtgagggctatacagtgacaatctgactaaaaacaaaacaaacaacaacaaaacaagaacactcttgtgatatgaagaacaaatcttcttggcccacaatggggttcttatttctggaaattttccagtatacactgactatatgctcagcagtaacatgttgacatgcatttctggtactatgtgggaatttgaactagatctgtggtccttactgcaggtaatatccaggggattttgagttatccagagatatctttagttggcacaatagaaggagatgcacaagggtgctaatagcatctggtgggtaaaagcccaggatggtactaaatacactccaatgtccaagacagctattcacaacaaggaatcattcatcccaaataccaacaaccaaaaatgaaagttttgactaaatgattactacagtatactcaagaatcttgggattctctaagggcatgaaaaaaaaaagggctacaaatttatgtttagttgctttctattgtcaatgctaagagaagaaagtattaccaagataaattgataaattaagacattctagacacataattctaaagttacttaatattgtttcagagtaaaaaaaggaatcttttaattggtataaagaaatacctataggttaaaatgtcatggtgactacagatcatcactaattaattagtcctgtactttgtgttgtaaatgatcacaatcagtatcttccaatttaacctgatttcattagcttcaaggtcttctatgtggtaatgaacttacagcactgtaccactagccagatagatactagatgttggaatcattgtgctggcctcagcttaacaagtatcttgacaattcaagacttgatgggatctctaacattgtttccaggatataattaaagatgtttatggtcccctaagaccagaaaaaagtgcctgtggacaggagttgagatcagaactcagattccctgactttcttcgtgtcaggtccactcattgcctactctagtgacatacacagcgattgggctcttcccacccttcactcttcaggcagtggcaatcgtaccacctatgacttctttaaaaatttttttcaagccagggtttctctgtgtagttgtcctggaacttgctctgtagaccaggctgacttcaaactcagagttctgcctgcttctgcctcctgagtgctaggattaaaggtgtgtgccattggaggggaagctgtagccacgcctacttaggggctggccacagatgtgcctgaccatgcttgcgagggcatggccaggatgacgtacagcgagacttaaaggggactgtgtctctttcggtttctcttttgggcttgcgtacagactgctgccacgccagctggctaggacgctctataagtaaggcttttccctattaaatacccttatatttccacttggctccatattggtaatttcccactatatgccaccgccaccaccccaccacctatgacttaaaatcaagtcgctttaacacttgctcagagctgtacaggggaccaggtctatatataagtcaccaggttagacatttccattaattatatgacacttcacatcagtccaacagcacagattttgacagatgcacaaaacagcgagggctggtctacagagtgagttctaggactacagagagacctgtggccagagctacagagaaaccgtgtctcaagaaacaaaaaacagaaagagagaaaggaagggagggagggagggaggtcaagtccaaaactggtaaaatgtcacacacaagtgagtaggaagcctcacctggaccacttgccatgggaaatcctgcctccatcctaacagaatttccagatgccatgggtccattcattctcacatcttggcttcggttctggcccaaagccaggttgatagcaccttcccctgaaaattacagtagagttataaaatggaaataaaagtaaaatactgataataaccctaaccctaaccctaacccagcaccccagaggtgcagggaagatgggaagctcaaggctgtgctcctacatagcatgctggagcctatggctagacaagatcctacttaaaacaaaacaccaaacaacaaaatgatttgtggtagagaggtcatgtaatgacaaatagagaaatctcttctaactaacctttgtgacataaggtaagactagcatgtgaataggtttataatggacaatgctggggattgaatccagggccttctgcatggtaaccatgtgttgtatcaatcattaaatcttctgtagtatgtgtggtgtgtgtgtgtgtgtgtgtgtgtgttatgtgtgagtgaactgggcggtggtggtgtgcacctttaatcccagctcttgagagacaggggcaggcagatctctgagtttgaggtcaggctaatctacagagtgagttccaggatagctagggctacatagagaaaccctgtttcaaaaaacaaaaaaataaaaaataaaaatttgtgagtcttttgcctacatatatgtatgtgtatcacatttatacagtacccaaagaagtcaaaagagggtgttggatcccctggtactggagttatagatggttttgggccactatggttggctcacatggttgggtgctgggaactgaacctaggtcttctgcaagagcagcaagtgttcttaactgctgagtcagctcaatattctatctcatttgcatttcacctggtaggtaacatcactaggattgtttcaattaaacagactctaaggaaacttaaatcttaactaggcctaatgaagacagctgctgagacaactttcagagtgctccttgcacttaacccacagtgacacagccacctttgtggggtgaagatacagctagcttgtcactggggagttgaaagaccatatttcccgctcctttcatatcacagaatcttggtttccagtctgaagataaagcaggaagctaataaggagatactttcccctgtcctgtcactgagctttctgtgtagagtttaatcaggggactgactgcctggtcctagggaacaacatcctcccaataaaggaaccaccattagaggctatagcctataagaatcaagagtgaaaaaatatatatatggggttttggaagtctcaccaatggaaaggaactattaatatattaaacctattaagacattttaagtagaagcatttttttttctttttttgggttggaggggtttttatttatttaaagagaagatcttaccctgtagactcggctgtctttttttttttttttttccccgagacagggtttctctgtgtagctttggagtctatcctggctctggagaccaggctggccttgaactcacagagatccgcctgcctctgtctcccgagtgctgggattataggtgtaagctacttcactaagtaacctaagcagaagagttcttgaaatgacatcaagtaatatcactccttgttttttggcagttctccactgccagtagcttagttagtaaagtgattgctcaggacctgaattgagttcccagcacccattaaaaaaaaaataaataaataaaaaagagcctggacaacacttataatctcggcataggggaggcagagacaggagcatcactggggtttgatggccagttagcccagcctaattggtaagtctgagtgaaagtattaaaacacaaggtagggccaatgagatggctcaaagggtaaaggcatttgctttcaagcctgatgacttgaatttgattcccaggatccacatggtggagcaagataactggttcccatgggtcgtctacatgcacaaacacacacacacaaaatatataaaaattatttataaaaagaagaaactcttgcatacttgcccacagttgatgtttacatcaactacagatataattcacatcaatcatagagttgtccttcttaattaagatcatgggctcatttgagttcctaacaatagtataattatataccaggtgctaaaacaaagtaatgttattatatccttccttgctttcattcaacatgtttattaaagagactaatgtataccaggcaattcaaaaatacgacagtgaacaaaaccagacaagatccctttcctactagagtttaaagtacacagaggaataaacaataaccataaccaaattcctgtcctaaggaaagtgtgagataaatgatctgggagaaaggaacttttgttagagcatagtaactgactccaagtcagccagagacttaaggctgcaaaaactaacttgaagaacaggaatgagacagtactccatatacagaaggcaacagtgcaaaagaactgtgacagaagggagaactgtgtgttcaaaaaaccaaatgaaaactggagagacagtaaagcagagggcttctgggggtagagagtgtggaattaactagcataagtttatatgaggaagacagacattagaccatgcaagccttgaggccatggtagagattttggcctatattctatgaacagcagcaagcaacagaagggcaagctggatatcatgtatgtattaggttgagcatattttacattcaagagggtcactccagtgataacacttacaaaagaactgttcaggactccctaatctgccacataaacaaaggaaattgtaaagttattcagtaaagggtagcaattaaaattagatattcttcaaaagacaaatcagtttctttaagagtacaagtaaaaccaaagcctgagactgaaggcaaaagagccaacggaatgatgcttcaggctgcagcaatacctcaatgcttctttattctaagtgctgcaacttgaagcacagggtgcacagctgcttgagagtctcaaacataagagcagaggaatagacaaagcagcatcagaaactatgctggatatcactgttactgtattttggttcagaagggcacatgacaaagtaaaggaccttcaatctgaacggagagaatccccagatcccggagctgctggttgttgctctgagccaggatccgtaaccgctccgctgcttcccgggggatgttgaaagtgacgcgaacgctgttccagggctccactttctgtacctttagtttgctggattcttggtcatgaaggaaagagaataacattatcaattttgtaggaactagaggatgtgcaactaaaaagcaaaacaaaaactcctgctttaggtaaaagttgagatcccactgaagcacaagaaaccgagggaggaaaacatacattcaataggtaagcttcatggagaacagaaaaacatctggcattctgcaattctgaaaatgacacaaactttgggacatattcttaagaatacacaaaagctaatttctggaaaaagcatgtttacacatgctaagtaaagagtgaagttaacctaatatcatatacaaaaattaactgaaaatggaacaaacatttaaatatagacctaaaaaaaaatctttgaagaaaatatgtagcaaaccttcaccaccttcaatttggcagtgatttcttggatacagcagcaaagaggcaagcaacaaaagaaaaaaatagaaatgctggactttttttatatatcaaaaaccactacagagtggttagatatcatatcacataaggatggctattacaaaaataatatatagctctgggcagggggtgggtggcacatgcctttagtcccagcattcaggtgacccagcagaggcaggtggatctctgagttctaggccagcctggtctacagagagaactgcaggtcagccaggactacacagagaaaccctgttttggaaaaaaaaaaaaaaaaaaaaggatacagcaaatgttgacaatgatatgggaaacctggggacccctgttcactaatggtgggagtacacaaatggtacaatttgctaagagaactatatggtaagaagttttctaaaaaaaaaaattatatgatatagcacttttaattttaggtatgatatagcatttttaattctaggtatcagaatcgaaagcaggatatgcgagagtatatccatgtttatggcagcattattcacaacagctaaaccatagaagtaatccaagtgtccagcaacagataaacattagtaagcaaaatggggtacatccataaattctgtggaacattcagcctgaaatgggaagtaaatcccatcatgtgcacatagagaaacactgagaaaactatgttaaatgaaataaagcagctgtaaagagacaaggactacctgactctgattatatgacataggtaatagtcaaaatcatggaaagaagcctggagagatggctcagtggcttagagaactggatgctcttcagaggattgagattcaattcccagaacatacacagcaactcacaactagctatagctctagttccagcagatctgatgccctcttctggactttgtgggcactgcatgcgtgtggggcatttacatacaggcaaaatacccatgtgcataaataaataaatctaatttttaaaaattaaaaatatcatagaaagtagaatggcgcttattaaaggctagagtagagaaggaatggggagttatatgataggtatagatattaattttatgtgagttatagaaatggctgctaatgattgttataaaatattataattgtattttagtaccattgaaccatatataaaaacggttaagatagcaaattcttctatatgtattttaaaatcaaagattaaaattaactgaggcagtaattttgtttataattacattttgcaggcagggaagcaaataaaagctatccagcagctcaagactaaataattttccttttgttattaactcagatcaactaaatggtttatatgctttattcaattacatctttcagtattaataaaatggccatacaggaataggctttctcaaaatccagacacctatgaaaaagttttacatgtcacttaagcctcttccagctcttaaaccattaggtactaaatagtaacacagaattcatttgctctaatgtacaacaacaacacaacagatcaattgctaagggcaattagattaatatactcacaaaatttaaaaatggttagacaacatttagccaacggtctcttacaggtaagggactggggcccagagacaggctaagtgatccagaaagctgcagctacctaatgaacttacagaaagcattaaaacccagctctagggtttaaaactattgacgttctgctgaaaaactttggatcctggttccacaggagagagacacgaagtttctttccaatctgatgatcactggaaacttacccatgttctacatatacatcatatacaaagcaaataggtatgatgtaataaagactataatctcagccttcagcaataagatcttccttctttctaaaacacaaactaaaaaataaataaaaaatgatggtgaagagacatgccttccaatttactttgcgtaacagtaaccatgaaaggggaaacattcaaaaagagtaaccagaaggaaacaaaaattaaagcaattacccatgtgtaacaagttgggcacattctttaatattgcatccagtttccatttgaagtctttatcatctatatttcctttgaaggctacaaaaattgtggaatcctccaaaatactatcactttttgtgtcatcatcttctagtccagagtcaaaatccacctccgagtcttccattgttgatgaacacagggaagtatagatgtcttcgaagtttggaaggtcatccaaaaccatggtgctttattccagaagtatatgcaaagtgaacaataagaaaaccttaaaaaaagggggggtgcagagtattatatattcaacatattattatttaacatatcacccatacttatgtgaaaggtgtaatttattcactaagtaaaatttcctttcatagtactatatgctactttttttttttttttgcaagactaggatactgacaggaatatataaaggctacagggacataaaagaagaggactgtgacagtgtatacctgtattttcaggagagagatcacaagtttgagcccaccctaggctgcagagttaagatcttgtctcaaactaacacaacaacagtatccagaaaatcctttgtaaaacatctatatctactttccagctacatttcaaaaattctaatttaacacctgggcaatggaggtgcacatctttaattccagtactcaggaggcagagggagacagatttctgagtttgaggacagccttgtctacaaagctacttccaggacagccaggactacacagagatactctgtcttgaaaaccaaaatcaaaacaaaattctaataaactctgcaagtaaataaataaaactattaaagattttcagggcttaaaatcttttgcttaacttgagaaaagactgagtcttgaaactgctcaaaatctgtaactatttagcaggcttttcaagtaggaactgcaagaaaaataacctaatgatgtatgtcaaaggcttagtaaaacaagaacaagccaaaccaaaattagtagatggaaagcaataacacaggctagtgagaggcctaaacaaataaatactttgcttctaagccttggaacctcagactgtcaaaaaaaaaaaaaaaaaaaaaaaaaaaaaaaaaaaaaaaaaacaagaaaaaaacaaaaaaaaaaaggtggtgggctggtgagctgacttagcagatacctgtgactgctgccaagtctaatgctgagtttgatctctgggatccatgtggtagaagcaaagaatcaaactgcaagtgtcctctaacctaaacacacacagacacacacacacacacacagagacagagacacacacacacacagagacacatatgcgggcacacatacacagagacacacatacacacacagagagagagagagagagagagagagagagagagagacacacacacacacacacacacacacacacacagagacagagacacacacacacacagagacacatatgcgggcacacatacacagagacacacatacacacacagagagagagagagagagagagagagagagacacacacacacacacacacacacacacacacacacacacacacagacacatattcgggcacacatacacagacacacacacacacacacacacacacacacacacacagagagagagagagagagagagacagagacagagagagagagacagagacagagacacacacatacaacaaagccatcgacacaaacaaacagtaaataaagatgtttaaacatttttttcataaaataaaagacaaaatgaatgccaggacaggtgttaacataatggattaaaataaaatataagataaatgaaacaaagagttagttctttgataagataatcagactaaccaaaataagtagacatgaatgaagaaaattaagagtctggagatgtaggtcagttgacaagtgcttgcctaacatgcacaaagccctggatttggtccctagcatcatataaactgggtacagtgatacacctatcagtacacggaaggtggaaacagatctggccacacagggagttcaaggtcagcctgtggctcaaaaggcttcctttcaaaaaggataagtgtgtacacatgaattacccaaattgaaccgagaggatataaactaaaaagatggctaaaacacagttaggtctggtgagatggctcagtgtgtaaaagcacttgcagccaaacctaagcttaatgcccagaaactacatggaggaaggagagaacggcctcttcgtgttgtttgctgacttctacacctcctggtgacacacacacacacacacacacacacacacacacacacacacacacacacacacacacgcacagaagtgagatgtagagtctggagagacagctcagcatttaagaggacacactgctcttacagaggccttgatggatttcagcaaccatgtgggtgttgggagttgaatctgacttctctccaagaacagcaaatactcttaccccctaaactaactctccagccctactcaaccacccccactcttattgaatatagtgcttgaattctctattatgtgtttgcttttttttttttttttttttttttttgtttttttttttttttttttttttgaggcagggtctctctatgtagctctggctgtcctggaacttactatgtagatcaggaaagcctcaaaatataaaataaagtgtgtggtatcattcttagctagtggttgaattctttaccaggaggtaaataaaaagtatggaaataagaaaggtagaagtcaaattactcctgtttacagatatgattatatatttaaagaccctaaggacttcagcagaaagttcttagagctggtaaatactttcaacaagatagtagatacacaaaattaacatagaaaaatcagtagcagtactagtgagatggcccagcagttaagtgctcttgcagaggactggagcttggttcttatgtcaggtggttcacaaccttgcctataactccagttctagggactctgatgtcgtcttctgggtacccacaaacacacatgcaaataaaaataaatcagtaggttctctatatactgataataggttgttaaagaaatcaaagaggtggttcaacagttaagagcactggctcaaatccaggttcatctcctagaacctacatagaggctcaatatctgtaacttcagtttcagagtatctgtcttcttcaggcctccatgggaactgcatgaatgtgatacacagacatacaggaaagcaacacacaaacaatatatatatatgtatatatatgtatgtatatgtatgtatatgtatatatatgtatatattatatatataatgaaatttaaaataaaaccaaaaagatggactctaaaaaattctcttacataaagcttcacttaccaaaatgtcttaatttttatcacttttccaggtcatcatctaaatccaaacaaggtggcatctttggggcatgtatttcaaagtagcagccaaatcagaattctttagaaaggaaagagaagaaaaaaaagaggggggggcaagtaaaaccacagtattaaaaagaaattagggtaaaaatacaaacaagtaagttataaagtcaatatggaaactctagaaattagaattttcattagaaatcctaaaacagccgggcattggtagctcacgcctttaatcccagcactcaggaggcagaggcaggtggatctctgtgagtttgaggccagcctggtctccagagtgagtaccaggataggctccaaagctacacaagaaaccctgtctcaaaacaaaacaaaacaaaacaaaacaaaacaaaacacaacataacaaaccaaccaacctcaggaagggaacaggcccagctgctcaggctggtgatctcagcactagggaggggagggggcactcagcatgaggattaagagttcaaggcgagccttcagcaaagacagcatgaggcctgcatttcataagattctaactcaataaaacaaaaataaacaggtaaattaataatttttttcaaatgtgagtcaggtagttactctgtagccaactctgatattgaattcttggcaatcctctggtctcaccttgtgtgctgtgattacaggcaggggctatcatgcccagctcaaatatttttattttgggagaatattttttaaagtagttatataactagttaatttaagaaagtaaagaaagaaaacaataagctgggtggtggtggtggtgcaggaggatctctgtgagtttgagcccagtttggtctatagattgagttctaggacaaccaggactaccagagaaaccatgtcttgaaaaaccacagcaaaaatgaaagcaacaaagaaaatgaaaagcactgaagactattttggtcaagattttgctcatcataacatatttttttttgagacaggaaaaatgttatttcacacttgctgcattaagtgttatgtaacaaaatagcttccagaaacaatctaaactaagatattcctgttgggtcacagtgtcagtttctctgtgtagccctggctgtcccggaactcactgtgcagaccaggtagtcttgaactcaagagatccacccataaaggcatccatgagcagctacaaaatcaatactatactcctcccaagttgagagcgcagcatgaaggcccttgcacccaaagatctccagggaaaccacgaatattaagcacataggatgtctttccaataggaaaggtgtaaaacctatttttccacccagaaagctggtcactggaagtgcttagcagcctagggatctgtgtcctgtgttggaccaggtcatatcaagtcctacaaccaggactggagttggctaatattctaaatgaacttcacagccaggggctcctcaagttcccacaaccaggaccagagctatccagtagtctaaatgagccttatattatgtgtatggccaggggctcccccaagctcccacaaccaggaccaatgtgggctaatagcctaaaagacctccatgctatttgaatgacgaaaaccaggccagacctttaggtctttaagctagtatgggtaacctatttcttcaaagaaatgataaggctgagttgagtttcgatgtaattatgcttccttgtgccacggggattatattacacccggaaacctttccccaaattatactgtgtttaaatttgttggataaaccacctgacatcagactccccaaagtctgatccaggtgaagtcaatctgaactaatttttcattctcaccttttcacagttctttttccccaccatggccattcactcatacagcacatacaaacgtaatgaaaaactaaacaatcctttaaagagcacagaagtctaatggccctgaagttgtcccagagcacacagtatacaggaaaacctttcaagtctttttttaaaatttcttttgtacgtatgtgggcataccaatgccacagcactaacacggaggtcaagaggacagcttcagagagtcaattctctccttccacttctttgtaggttctagtgactggatgcatgcaggtaatcgggctttgtagcaaacacctttatggaataagtaatcttgcgagcccttcaattcactttatgaagtaaatataaatactcaatttgtaggcagaaagctacagatcaatctttcttacattgtttggtcttacaccaacgtttgagattctgagttaaattttaaatagactctggtagtactttaaaagaataataatgcatcatgaccaagtgaagtttgttgttggaattcaaagcaaacttggtatcaggatactgggggaaaatgttatgtggttctctccactgatgtaacttagccctgtctgccaaactgggtactgaatctaggcttttatatattcattttaactttgccacttagctatttccctagtgcccaccccctcttttttgagagaggtaccaactattagggtggcaatttacttaattagagacagggtgtgactatgtagccccggctgtcctggaactcattatgtacaccacagcctggtctcaaatgaatagatccacctacctctacctcctaaatgctgggattaaaggtgtgtgacaccatgccagcctgggctggactggcaatgtgtaactcaggctagccttaaattcttgatcctgttgcgttagcctccagtatatctggattagaagccaaatgacttaaccattcattcttgatgacaatttttctaaatttcaaaaaaaacatacaaatagccatgctttggtggcacacgcctttaatcccagcattagggaggcagaagcaggtggatctctgtgagcttaaagccagaatgttctacagatcaagttctagaagaatcagggctacacagagaaaccctgtctcaaaaaaaaaaaaaaaaaaaatacaaaagtacaaaaaaacccaaatgctttcttaacatgacaacattgatttcttcagcacaaaagtgaggactagtgtgtaactgggggaatggtggggggaggagtacttgcatatgtgaagcacgacacacggaaaacaacaagcacaagtcagcagcagcttcacagaggagggcagggtatatcaatgaagtcaggagcacagaagtataaaaatcagtaaaacgaaacaagaaacaaaggttaaaaaatatcacaagggctggagagatggctcagaggttaagagcactgactgctcttccagatgacctgagttcaattcccagcaaccacatggtggctcacaaccatctgtaatgagatctggtgccctcttctggtgtgcagatatacatcgaagcagaatattgtatacataataaataaataaaatcttttaaaaaatcagaaagaatgtaaaactaacaaaaacgacagacttgaaagtctgtattcttgaaagccaagcaaaggacagataaccaattaagcaaagcggcatggtacaaaatatacaggaaaaaaacccagcatttattacctatgaattcatcaacacatggggtaagatctcatttttaatagtgacaagaaagttagattctttaactaaagagaaaggtcaagatataaaaagaaaacctaaaaatacttatgaagggggttggagagagagctcattggtagagcacttgttgctcttgcagggggatttgggttcgattccaagcatgcacatggtggcttgcagccatccataactctagttccaggggatctgaagcctggatctttgggaaccaggtagatccatggtacacacccataccatacatacatgaagacaaaatgtatacatcaaaaaaattttaaatgcttatgaataacaaaattttaaagacatggataaagtaatactctcatgtgcaaagattcgcatgtgttagttttccctaatttataatttaactagacaacctgactctaaggtttgtaggaaaactctgaataatcagattagaaaatgtttaaaccgtatcagattaaaacttgttattaggggctggagaaatggttcagtgggtgacagtgggtgctgtgcaagcatgagaattagaacccaaatccctagcacccacataaaaagctgtgcatgggctggagagatgcctcagaggttaagagcacggactgctcttccaaaggtcctgagtttgattcccagcaaccacatggtggctcacaaccatccgttatgaggtctggtgccctcttctggcctgcaggcagaacactgtatacatgatagatagatagatagatagatagatagatagatagatagatagatagatagatagatagataaatcctttaaaaaaataaaaagctgggcatggcaagtgtgcacctgtaactctagcattgtggggtggatgcaagaggttcactggcttgctggctaccttatagctccaggttctgaaagaatttttctcaaaggaataaggtggagagtgacacatcaggacatccaaagtcctctgacttctaggcaagctggttctatgccccacctcccatatgcatttaccacacacatacacacacacacacactagcaagcattgatgcatacagtatattctcaatagttagacctactatggaaatttatagtgcatgggagattaactgaattttggaattttaatatctcataaaggtgaagaaaaaatgaattcttgtctttatataatggaacaaggtagtcatctagaagattaataaaattagatctatttctcctgctacacaataactccaaacagaccaaaaacttcaaatattacatcttagtattatagaaacacagaaccaacatttgtaatctttaagtggaaaggcttttctaatgactcaaaatctaaagccctgtaagactgatcaaacacaaacaaatagctggtcatcgtggcagacacctttaattccagcactcaggaggcaaaacaagtcaacctctgtgagttcaaggccagcctggtctacatagcacgttccaggccagccaagtctccattaataagatcctgtctcaaaaataaataaataaatagataaataaataaaacaaaaaagggggggcaccaacagaaaagcaaatctcagggctgagggaattttcttacttagttagcataagcaaggtcttgccttcaaaccccagcaccacaacaaaagaaaaagcaaatgacaggggtagggtaagttcaatcttcccaaaactcagatggtagaaggaaagtactacctttcctccagcctccgtatataacaccacggcactcacacatccacatacatacacatatcataaatgttcaaaatttttaagtaaagtttatggactcagggatagctcagagtcagatgttaggatagctcagtggtttagtgcttgcctaacacatatgagacactaggttcaattccagcactgcccaaaaaatttaaaagtatatttctaatttaatccttttagttgaaactaagtctttcaagatattcaactttcatttgtattccatagaattgacagacctgtttaagaactctctgaacactttcagagaaggtagtcaataggacccctctccattcctcccaggacctagacaaaaggggaaaagaacaaagaagaggagaaatatcagaaaagaccaaataaacccagtaaacagattctaagccaaattccacctattattatttctgttaatttattctaaagagttgtaaaagaaatgacatatagtctcttagcacagtggtttttagcaagtaaactattatcaccaagaatgctcaaggtattttcaaacagctgtataacagttacttacacatgtcaattcatttttaaaatcatgatgtttacagtttgtgctttgttttgttttttgagacaaggtttctctgtggagcctgtcctggaactagctctgcagaccaggctggctttgaactcacaaagatttgcctgcctctgcctctggagtgcttggattacaggcatgcaccaccactgcctggcacatttttcttaatgaatattatatttcaattgacatacttaaaatacagacacatagcccaggaggaaagcctgggctatgcaatgtattctaggctagcctgtgaaatgctttgagactgtctcaaaagaggaaaagaggaagagcataggagaagaggaagggggagaaagggaaaggagagagagagaaaggcaatatgtatttgcccaatgtagaaaccctaagagatttataatatgcattggagtctcacaggctagctcatttgtcccagcttgaccacacagtccatataggtgttcttctgttttaaactataagtatgttgataacatcatacattttaatttagcttttattttatattctgaaagaattactttataaatgacaactgtaaaaaacgaacaaagaaacaaataaataaaaacaaacaaataaaataacagatgtcactaacccacaattgtgccatagtacagttactataccatccattcatggaaatgaaataaagcctagaacccatacaaacatgtcctaacctactagtgttcatttttcaaatactaagatcagctggtatacatattcagaataatatagctttattcactatttatttatttagacagaactagctttgtagtccaggctaacctaaagctcctaatcttcccacctcagccttccaagtgctagggtcacaggtatgtgccaccatgtctgactctgatgagcaccaactacactaacacacaatgtgatatgggaagagagaggccgaccatactagggtggctttgccttgagttctccttgtggcagtcagtaaagttgtgaggcaatacacaatttttatgaatcaacagttctttaagttatataataagatgccagatcatgagctacagctaaatagattttcaggtttcttttaggttttaaaacattcaagaactataaacaaaacatttattcttctccagtgtaagtgggtagggaactatgataacctttgtcaaaaaactcatctcacagtttaaaataaaactgaaatttatcatttggggatttacagaacaaaaaaccctacatttaaaaatatacacaaataatatgtaagattgtttataatggaaagactcagaaatatccactgaagtacataatcaaaatatgcagttgataaaaattaattagatatcattttatgatttagaaagaaatgtatgatatactcaaaggcaaaaaaattaaaaaataaataaaaatagaagttgtaggccaggtggtggtgcacacctttagtcccagtactcaggatatagaggtgagaccagcctggtctacagagcaagttccaggacatccaaggctacagagagaaaccctgtgtcaaaaaaaaaaaaaaagaaaagaaaggtttttaactcaagagctttatgctttacagatttgtctgcttaaaaaattattttacttatttattagtttgtttttacagatacagagctggagaaatggctcagatgttaggtgcttgctatttttctagcaggctggagtccagatcccagcacccttatcaggcagctcataacctcctgtaaataactccagtttcaggtatccagtgtcctcttctggtatctgcagacaggcagacatacagaaacacacacacacacacacagaggggaaaaaaaaaagcaggcacaaaccatcacaaaatcctacaaaagaaatgcctccaattatattatcaggtgtttgtgtgtaacctcctcaccccagctctgctttcagttatctcctaacactgaagtttatctgtaataacagttgatcaatttgggttatactgaatacaattttatgtgcataatataaataaatatatatggaatgtatcaaatcatactgaacaaatggccaaatgagatgaaaagtgctaattaatacaatatattttctcagatacacatttctaagaaatcacaaagaaaaaaaaatgcaactttataatagagacctagcaattaccaccttagtcccctgatcactcacataatagcaatgtggcaaacaggaaggtacaggaaggtaccatggaagtcaagcattgcaggaccaagtattcaatagtgtaacatttttttaaagacatggatgacgggatagagagatgactcggcaattaagagcacttgctgctcttgcaagtattcaggttcagttcccagcacccatataatggctcagagaattccatcccctctttggcctccatgagtattaggcacacatgtgatacacatacacacatacatgtaggcaaacactgatacacacaaaaataaaaatgaatactttttaaaaaatatgaagaacctgaaagaagcaatgaaaagattatgaaagaacagggagaattctttttttccttcagatggggtctctatgtagccctgtatggcctggaactcaccatgtagatcaggctagttttgaactcacagatccagctgcctctgcctcccaaatgccaagattaaaagcatatcccactatgactggctgggaaattctgaaaaggtgaattaagctcacttaattttacaaaagaagatttctctttaaggcaaggagaaaacttagaatgatgtgtttcgaggaggaccctaagagagacatacatggtcccccagagaagaggaaagggacaagatctcctgagctaatggggaacatggggggaggggagagggagctagaagaaagagagggggaaaagaggaggggaagaggacaagagagaacaggaagattgaatcaggggaagaatagaggagagcaagaaaagagataccataatagagggagccattataggtttaaagagaaatctggcactagggaaatgtccagagatctatgagtttgaccccaactaacaatctaagcaatagtggagaagccaccttaaatgcccttctctgataatgagattgatgactaccttaatgccatccttgagccttcatccagtagctgatggaagcagaagcagacacccacagctaaacactgagctgaactctggaatccagttgcagagagggagaagtgatgagcaaaggggtcaagaccaggctggagaaacccacagaaacagctgacctgaacaaggggttgctcatggaccccagactgatagctgggaaaccagcataggactgatctagaccccctgaaggaggaagtcagtttggaggtctgggcaatctatggagcctctgatggtggatcggtatttatccctagtacacgaatggacttcgggagcccactccacatagaggaatactcactctctcagcctagacacatgggggagggtctaggccttgctccaaatgatatgacagactttgaagattcccccatggaaggcctcaccctccctggggagcagaaaggggttaggatgggggggaggggacaggggaggaagagaaggagagggaactgggattgacatgtaaaagaagcttgtttctaatttaaaattgttctaattacaattataaaaataataaaaaagaatgttgtgttgcttttttgttgtagtatatgaatctcaagatactgttcttgaacatagatgaaacccattaaaaacatgctaacacattatggttgtccttctccgtaaggtttaaatgttcaattattggtataagatttcctcagcatattgcttctttgtctgactaagttgcaaaatccctttttagcctggcacattagataacagtactgagtccaggctttgtttctccccacaaaattaagtactgtgagcttcctgttgaatataattctgtagctttactttgtgcttagacctcatttgctacacttgctgttatttattccctttggatgcttttcaagaaattcccctagctgaatataaaggataatgattttattatgattgttcaggaattgaaagatcagcaacatgtatgtccatgcttatataatctgccaaaatcttttctgtgtgaatgctcatgtttttgtccattactatttctagtgttaccctcactgtattagtaagatcccaagttatttaggcatttgactctagaatgtaatttacaacgtatgcattaaaaaagattcacagctgggcgttggtggcacacgcctttaatcccagcacttgggaggaagaggcaggcggatctcttctgagttcgaggccagcctggtctccagagtgagtgccaggataggctccaaagctacaaagagaaaccctgtctcgaaaaaaaaaaaaaaaaaaagattcacaaagcagatgtggtagtgtgcacctttaatttcagcacttgggaggcagagataggtggatcactgtgagctcaaggccagcctggtctacaaagtaagttccaggatacttacaactataaataatttttctttttcgagacaaggtttctctgtattgtttgagcctgtccaggcttgcctcgaactcacagagatccacctgcctctgcctcccaagtgctgggattaaaggcatgtgccaccaacgcctggcttgtaagtaattaaaaaatttttttgttacattagtgggcatacactcatgcacacaacgtacacatacagaggtcagaaaataactgttgggactaagctttctccttctatcatgtgggtcctggggttcaaactcaggtcacgtaaagatggaaaatacacagtctgaatcctgcatattattgtgctgtctttaaactttttgattgttgatgaaagagctgctaagagacattgtattatgaaagctgctagattaaatcaacctatttattctaaaaaatatcttgacttcaaaatggaagtcaaaaggtgtgttgctttgggtgataggtcatgcttttatttctacaagaaatgagaggtgggggctggagagatggctcagaggttaagaacactggctgctattccagaggtcctgagttcaattcccagcaaccacatggtggctcacaaccatctgttatgagatctggtgtcctctgctggtgtgcagatatacatggaagcagaatgttgtatacataataaataaataaaatccttaaaaaaatgacaataatgtcaaaaagttcacttaaaaaaaaaaaagaaatgagaggttgtggattcatgccaggttgatatggatcaggtttgatcagagaagacctcctaaaaatcctggctacagacacacaaaataatcctaggaaaaatacaaaacacattaacatgtattttactagaaaacattttaacataagataataataatacagtctatacttgtattaatgcagatatgtatattacctttagaagtttatgtattttcagagcaatggaaccagagcaaatggcccaggtaactcagcatctcagaacacttctgttacagtttcattagagttctatatccaaacaatttccgggatgctggctgagatggtccagcctcacagactactccagccaagacttaaccattatcctaaatttttcagggtctccctaaaatgccagtgttcccagatagtaggaagccatctatggaaagcaacatctacatccccaaaagatgaattatggatgtttgtctttgtttagggggtttggtcacaaattattattggtcatggtaaaaaaaaaaaaaaaagcaacaaccaaaaaactaaaaaacaaaacaaaacaaaaaggagttagattcaaagatctcttactgaaggaaaaaagggggatataatatagaaatgttgacatgaaatgatagattattgaatctactttaatcaacaaactattgatctcaaaatattttacattggcatggattttggttcattggtacaaatttacatttgttatactgtatattatgtttctactgttgtttagggtattgcatttatggagctcatttaaaaatgtaatgtataattaagaaatacagattgattgtagtcacccataataatcaagctttctataacaaacttataattctgttaggtatgttttcaaggtcatacacagatttatttagatagatggtcttcaaacacttcaaaaaccaatataatatggcatttaatatgtttaatacaccaaaggcttttcatgacagtgagacatgtctgctcttgacaatctacttcaaaaaaaaggatgatgggcatcaaagaacctccgtatggagttggctttctttatggcaaaagctagccatttgggcaaagaaattgctcttgcctcaattgctgacagtatactgtcctaactggaccagcagtatgcaaaaaagtgactgctaaactttgccaagacaaggtagatcagttcttcaaaattccctgcttcttataaatgtctgtcagatatacaaggcctgtaggccaaagatagatgtcacaaccttacagaagaactttgggtaactgtccaggcagccagatggccttgccattaggtaatattacaactttctaggatctttgacggagttaaaaactaaataattagacttaaagttttccttagttatgacaaaaaggtgaattaggtacaaaactctagactcacaaagataatattttaagattagcaaatctctaattttgctaaatataaatggattggatattataattcttacttgataactgtttttgttgtatataattgcattatgttaaaaccttccttttttatttagacaaaagggggaaatgaggaatatgtcgctgtggttgatttaataaagaagctaactggcctataggtaggcagaataaggttaggcgggagaaccagactaagaggatgctgggaagaaggaggagaagacttgggagtcttgagcagatgcagagagaagcaagatgaacatgccatgttgaaagaaggtactgccatgtagcagagggtagataaaaaatatgggtcaatttaaaatgtaagtgcaagctagtaacaagccaagcatttataattcatattctctgtgtggttatttgggaactggccggtgagacataaaagtctacctacagtaattatatctgtatttgtaagatatgcatgccacagtatggtatcaagatgcctttatttgtttttggttttcaaaatagggtttctctgtgtagctttggtagtcctagaactcactctgtataccaggctggcctcaaactcacagagatctgtttgcttctgctggaattaaagccttgagctaccaatgcccagcaagatgtctttattttatatggtttaacccattaagaatataacaacatgttaaacagagatgacaggcactatgacaggaggaagttagtgtgtatgaaaacttgtatgataaagtattttaagtatcacacagctcccaaataaactgtaatgtagcagggtgttggtggcacatacctttaatcccagcacttgggaggcagaggcaggtggatctctgtgagttcaaggccagcctggtctacaaagtgagggctaggataggctccaaagctatacagagaaactctgtctaggaaaacaaaaaccaacaaacaaacaaacaaacaaaaaatgtgatgtattgcaattgtgctacaagaaaataatatataaaatccagtttaactagtagctagtagcaacagaaactggtggtcattctaaagaatgatatgacaaagtagccaaaaataatatccttagtcctaattttaaatcactttagggaatatagtctaagagaaaaataggaaaggcttaaaaacagatgttacgggggctggagagatggctcagaggttaagagcactgactgctcttccagaggtcctgagttcaattcccagcaaccacatggtgactcacaaccatctataatgagatctggtgctctcttctggcctgcaggaatacatggaggcagaacataaataaaatctttctaatactttttatttgttttttgtttttcaagacagggtttctctgtgactttggaagcggtcctagaactagctcttatagaccaggctggtctcaaactcacagagatcgcctgcctctgctcccgagtggtaggattaaaggcatgcaccaccactgcctggcctaataaataaaatcttaaaaaacaaaacaaaacaaaacagatgttacaaaggtacaattgagaattgcaagacaaataaaaaaacaaattgaaaaatacttaaacaccaaataatcaagttttgttattttgtgtccactaaaaatggcagatacatagacatgactaaaagtgcatcaatactgttaccaaataataaaaatatatgtatggtacagaaggctgtgtaggtgataccttgtttatactctaataaataaagcttgcctgaggatcagagagcaaatcatagaggtatggaggtctgtacagacagacaggaaataagaatgttgggcagagaaatataaaacaggaggagacaggaacccagtctcttttcagtttgagtaattcataggggtaagagctctagaggctggctcctccacttctcagatctttcagctttcaccctcgcaccgccccatatctgactccaaactttcattattaagacctattagaattcatgttgcatattggcacccaacatggggcttgaaaccatgaccctgagattaagagtctaactttgaattttccaaatgctaatgagaaaggaatgacagctgtggagagacagaaaaactacagaattaaatcagcctgtgtacttttaaagatgtgctgacctcagaatggaaaccaggatgtgtgttatattggggaaggggttttgcttttgtttccacaggagaagaaaagctatggataccatcaaaattgataaagattagatttgaataggagacacctcttgattagaagaggtgataattaatcaaacaacatggctatccaatctaaactaactgtaaaacaaatgcttttcatttgattagatataacttgctataagggaacctccccaaaattagggtcggggaagtgctttgtttttgtcttttcaggagaatgatggcattcagctaaggaatctgaagaccactggacaaatgagacatatgaagaaaaaggacaaatcatccagaaaaaaatgttccaagaaaaagaataatttggcctattactttatcacatctccaacaagatacaatttcataaattttccaaaatgtttgtttctgcttttctctaaagacatacaatgcaaatggtctttttgtaatcctagttcaattaaataccaaagctggctttgcagttggaggatggctctctccttctctaaacccaagcatgcttattaaagcaaaatccaaaatctctgtcttatgtcagaagagccacctgatatagacagaagaaaaacaaaaattaaaggactattttattgccactaatctcataatactttggttctattttgagtctttgaagcttttcttgatataaatattatctaaaaatttataagattaatatatacatatttaaaggttttgtcaccgtatactgactaattctaggaaaaggcttcatctgggttcttgtacatgattctggatttgaatccctatcaaataactaggaattaagttttcgtactctggatgtacataacaaatattgatcccatatgctcttttgagatatgctgcatattacatttaacatgtttaagttttctgcagtgaaccatgaccacacctaacagcaacctttgaattatcaatgaaggatggagccccacaacaacaattccaccaggcctatggtagtaacaccactaagtccaaatgcaccatctacagatgagctctggactacaaactgttcaggacaatttcgaggtagctagctgagatgatgcagcctcacagactatgctagccaggacttgagacaagccctgcaatttcccattacacagagactggacaacaaatgataccactacctctcccaggacctgacaattaacccaaatttttcttttcagaattccctgaagatgtcattgcccccagacagcaggagtaaatttaagaatatgatgcccacattcccaagaggtggggtgtttgttttggttattcaatgggttatggatgtttgccattgcttggttagaagttattactggtaatagtcagaaaaaaagttgaacaaagaagattagattcagagttcttgttttgaacggaaaaaggggggatatacatatgataggctataagggtagattattgaatctactctgaaaagaaaaaaaggggatatagaaacaggataaaaaggtagattattgaatttacttttaaactaagaaagcaactactagttttaactattttatattggcttggagtttttgtgtattgacacaaagttgagattatttttgttagaatatactatatatatatatatatacatacatacatatatttctaatcttgttcaagctattgtacctatgcaactcatttaataaggtaatgcaaatttttagcctttaaagttattattatcaactacttaataaaaaatgcaggttagtatgtagtcacttatcacaatcaaacttacagtcatatgaagtatatcttcaaggtaaaacacattttagatagacagggcatcttcaaacacttcagagatctgaagaatatgatatttaagatgttttaatgacatatgttctctctctctctctctctctctctctctctctctctctctctctgacaatacgacatgtttgctcctggcagtaccaatctacttcagagaaaatgggcatcaaagaaactccacatggagtttaccttctttgtggcaaaagttagccactatgcaagaaagtgttcttgcctacactgatgacagtatgctgtccaaattggacaagcaggacaaaagaaaggactgccaaaccttgccaagacaggatagcacagtccttcagaatatcctgcttcacagaaaagtctgtcagatatgctaggtctgtaggccaaagatggatgccccaaccctgcagaggaaccttgggtgactgtccagaaagccagttgtttctgttatttctcacatttttttttttggaagtctcttgcttgtacttcctgcttactcaggtctctgatggagttgaagactttacagttatagttttcctcgttgccagattcagaaaagaaattcactaaagaaatgtaaagtgtataaagttgagaggtagaaaaagatagttttcataatgcaagttaaaatagaaagtgaattaggtacaaacttttagacgcaccaagatagaatagatatggagtactttttctgaatttgtcaaatgttaatggactagacactgttgatgtatttattgcatatatatagtatatagttaatgtacttattgtatatagtttttcttatattagttataaccttttttatttttaaacaaaaaagtagaaatgtggtgatatcttgtttgtataacaaataaagcttgcctaatgaccagagggcagatctcgcctctagctaatcatagaggtctggaggtctatacagatagattgtcagataaaagggccagccaaagacacccactttggccctaataccagatccaactctgcccctaccaattgaaacatgaaaccaaccaatccctgagccagagcctttactctgaacccagagccagtgaaaaaaaaaaaacaaaacactttatccctgaacccagaaccaaagaaaaacatcctgactttgaaaccagtgctgaagaaacacactttgtccttagaatcacagccagtgaaagaaatacgccctggccttaaaattagagacaaaaggctaaaaaggaccagtgaaagaaacacagctctgaaattagagccatctctgcccagactcactaaactaaccaatccctgagcaggaaaactaacctgtctctgagtagaaaaacctctctccctgggaaaaacgtcttccctaataagtcctatgtaagcccctctgcctgttcagttgctggctgtcctttcccaccctggcaaaggcagtcactctcctggaatcctcctccccaaataaatctctttctcaagagtcttggatgaagatcttcattccttggtgcagaacagaagaacttgctgggacgttcccttaggggtactgagcaaggctgaaaagaacagaacagaagaaacttgccggaacatacccttaggggactgagcaaggctgcagcagaaaaagtaacaatttttctccagagccggaggagattgctacatttctgcagaggcttcccctttagcagactgtagccaaagagctaaagaagaagcagagcagggctcgctcggctgtaaaggctttctcggagaggagcaggattgctgtatcctgcggagagactaacccccattgcatcctagcttcaggtagcctggcttcctaacaagtcacaacacctttctctgcagggctgagatggccaagggctcccgcttccagagctgtcttaggtagcctggcttcccagtaagtcacaacacctttctctccagggctgagatgttctattgcatttccagcctccacagctgtctattgtggctctgggtagcctggcttcccaataagtcagggcaccctttttggttttttgtttgtttgttttacaagacagggtttctctgtggctttagaagctgtactagaactagctcttgtagaccaggctggtctctagctcacagagatccacctgcctcccaagtgttgggattcaaggcgtgtgctgccccccccccccttgtagctccagagctacatttacacttgcttatattttggtgcaaaatccagcactcccactcgcttacacagacaggaagtgagatgtttgggcagagaggggaatataggtgggaagagacaggaacttggtttctctcagtctgaggattttgtagaggtaagaactctagctctgcttctctgaccttttagctttcatcccctaacatctgactctgggcttttattattaaaacctattagaattcgtgttacagaaggctctgagttagattcccaaaaacttaaaaaaacaaaaaacaaaaaaaactacaaaagcctacacgaattaagcttataaagactatataaactaataattatatttgcaataaacacaatttttaaaaatttcatggggatacttgttcttaaacaccaaatcaagaagcattgccttgacacaactaaggaaaagcacctgaagaccatcactgatcataatttgaatgagtatgcagtttgaacacagtctttcctattgtggacaaaaccaacaagctctcattagcgagacaaagaagctaatagatgactcagtcagtaaagtgctttctgctccagttaaggattgaattggaatctctaggatcctgataaaaaaagttgggcatgagggatggagagatagcttattggttaaagagcacttgctcttgcagaggacccacagggtgactcacaactacctgtaactccagttccaggtgatctaatgccttctgacttgcactggcaccagtggtttgttggtcctcagttgggagctgtttgaggaggatgaggaggtatggctttgatgaagaagtatgtcactgaggataggctctgaggtgtcaacagacttataccgtttagcgcttgcttcttttgcctcctacttatggttcaagatgctagctctcagtagcagcaaaagaaaacacccgatttgacctctagcccccacacgggcacatacatgtgcatatattacatatgcattctctctctctctctctctctctctctctctctctctctctctctatctatcaagggggatctatcattaccttgcataatacacaatcttttgttgttgttggtttttgtttgtttggtttttcgagacaggttttctctgtgtagctttggagcctgtcctggaactcactctgtggaccaggctggccttgaactcacagaaatccacctgcctctgcctcccgagtgctgggattaaaggtgtgtgccaccaacgcccagctgtgaatcttttttaatgcatacgttgctcacagcccttttttttttttttacatggctctattactcagatatatttttcaaatttatgtgtttgagtgttttgcctacatgttatttatgtgcaggatgtgtgtgcccaatgcccatggaggcagaaaaggctgtaagagtccctgaaactggagttatgaacattgtgagctgccacatgggagctgggaaccgaatctaggtcctctgaaagagcagcaagagagcccttaaatcaagccatcactccagcccacacaactaagatcctttaaagactatggaaaaactgaacaggtttagagaaaaaacaaggagtaaaggacagtaaacagaagaatgaagaaaagtctgtaagaaaatgaaagcaatatgattatcaatgtctaaacccacagacaggcttttgaatagagaccctgaaaagctatttcccagtgcccacagatgactgaccaagaagagaagcttcataaaatccacaagattactgggctattgttcttcataagaagggctttttcttgactatcctaatgatgaattattgagatgagcaaataaatggcagatgtgttaaatcactgattctctgttttaactcagggtgtttatttattcatggtctactgacaactgtccctaaatcttgaatcagttacccaaaacttgaatcactgaccacaatttaaaaattctacagtgatatcctgctccccaacactgtctagccaccaaagccatcaatatggaaatgtcctagatctggcatccatgccaccaacaaactgctctggcttcatcttctctacaactcaacacaccagcaaccagacatctcactatccaatgacctaaatatgcttcaaccattttatgtccaccattcccttgattcatttccccacttgttacaatcttactctttagtattcatttatttagtagatttcttgattgtgtatatgtgtttatgatgtgtgtgggacatatgtgccatggtgtgaatgtggaggtcagaggacaactttgtggaaagcaggaagcacctttatctactgagctgtcttgctggcctatttagtaaattttaatttactagctctgtgccatctcaaatgccacctattaagagataaaatgtgtcctcagatcagtttaagtctttattctcagaaaggaacttaatttgaaataggaaactagttcattaagatgaggtggtatcagacagaggaggctcttaatccaatgatttttatctttctaagaaggacatttggacatagagatactgggatagctccactccacaaaggaagaggcaaacaaaaagaatcaaaaattaatgtaagctgtacatggcagcacaactccctaaccctggcattcagaggctacagcaaacaggcagaaggatttactgaagcctgaggaaccatgacattgttggcaccctaagttcacaatctagcctaggttttggtcttcaaaactgtaagaataaactttagttttaagtcaccgagtttgtgtctctgtaactgaagcccaagaaattaatacgccacctttcaccttttccatttcccaaattcccacagcactgtgttgttttatatccagagactgtcttgtgatatagtctagctgaactggaactcactatgtgacctagaatagcttcaaacttatggtacttccttttcctgcctcagtctatcaagagccgtgactctttcccctccttccatgttcacaggacctttctagatgaacttttttctggaaagcagaaactattgatggccctctgtacctaagagtactgcattaaaaaaatagaaaattacatttatactaatttttttctttttataagtctgtaaacaccacaatataattaattatatagtattcatactgtattgggtattataaatattctacacataatttcaagagtacaggaggatacacagaggttaaatgcaaatagggcagtattttctatagggtacttgagcatctgtgggttttggtatccaagcgagtctgaaatgaaacctccatggacactgaagcccaaacacattcatactctgtgcatggctcttaacacctggcctgtattcaatatacactgaccaccagtcacattccctaaccaacacacttattttcatctgaatggttctgagtgcatcatctccatatatgctgacaagttaaacacggcacaaaaattttctactgaaaattcttagtttttgtcttcttggtgcctttcaacagtcacaacaaccactctaccactgagctacatatccagtccaaagatgctatttcttaggaaacattcctagattcatagctacttattatgtcaatacacaagattgttatgtacacatactgacttagctaatgtccacaatggaaaaggatgtttaaaaaataccttattgcggaaccacttcatttgacttattctcttctcactatctaggccagattgcgtagaaaatagaaaccctcctgcctcaggctcctgagtgttgggattatagacatgtaccatggcacctaggtcttgattctctcttagtctttaataaaacatagtttacttaaaatctttccaactttgctagcatttggtgggtaatgatggtacttttgaatttttccaactgtttaaattctttaagtctatattttataggaagaccacagagttacttccataaaacattaaataaatatagcaaagaagatggtgaggtgctcagcaggtaaaggcactagttgccaagcccagcaacttaaattcaatcaatccctggggctcaatggtaggagaaaatagatttctacaagttgttctctgacttccacatccatgcacacacacaacaaaaacaataaacaaatacaattaagaaataataatataagaagggacttaacctaatgaataatttcgcaaatagtaatctgattcacaaattcaccattatttcttcctgagacctctgtttgagctttagaaaatgtaaatgggcagtgtgaaataaatactcaacaggtttagtattaggtaaatgagatggctaatgagaacttctgttgcctttgtgtgcatactggggatgctgaagttagacactgatatatacagaatataaatacctatttatagagtaagtacccttcaaatttgatggacattagtattgatatatatatatatatatatatattattattattatgcatagtgttctggctacaggccagaagagagcaccagatctcattacagttggttgtgagccaccatatggttgctggaaattgaactcaggtcctctggaagaacagccaatgctcttaaccactgaaccatctctccagccctgatcattagtattattaactgggacaagttaatattattagctgatcactattctaaatgatacagaataggaaatccctcacaattatgtattctggtttgtatataaaatacagcataacaaactgtatggctgccatttactccttccaccagtagggtttattccctttatgtacttatccatacatagctgtagacatttattaaatactttactagttattatctggggggtgctcaaagggctgtcagatctgaaaatggaattacaagtagttgtgagctgcctgataagggcgctagaaatcaaattcaggttctttgcaagaacaatatacattcttccttgctgagccattgctccaggcttagaaatttattaattaacttagcaaatatttgttgagctcctaagcacccaacatatgtattttttagaataaactaaagtagaaaaagatcaaatattttaaagtaaataaatatgctagattacacagtagacaatggcaaggaaggggagaatgtaggagcaacccttggcccagcccccaagaagcactcagtctaatgagcatcaagggaataaaccggctctatcatttccctttctctccatgttgatcgagtgcttcacaaaagggcttcttctcctaacagtcagatttcattaaaacactaaaaactttttttatatataatttttcaagacagggtttctctgtgcagctttgtagaccagaaaagatggccttgaagtcacagagatccgcctgtctctgcctcctgagtgctatgactagaggtgtgcgccaccactgcctggccactgaaaacttttctgatggcttccactgtttagtcaatcaagtcaaactctccaaaatgaaacagaacattcaaaatcttccacaaaccagatgtgtggcataaacctataattccacaactctgaagagaaggcaggagaatctcaaattcaacactaacctgggctccataacgagaagctgtcttaaaacaaaacaacaacaaaacaaccaaaaaagccttccatgatccattagcaaatgcacaaattacgaagacagtatttgcaactagactgtcagaatgcaaatttattatcaactgttacctctatcttttgcttagtctataaaaaagggggttttaaaaaccaggcttcttcactaagttattatgaggatcaaataaaatacaacttgtgaaatgatcagcacctacttagcaaacagtaaccatgctaaaatatgagtcctaccactccttttaaaagttttacctatcattgttgctgccattcaatcttcatttcgaaccttatctccaaaaacactgtgtacaagcctgttttccaggcaaatggaactagaactctttatttgttggagtgtgagtgtgagtgtgtgtgtgtgtgtgtgtgtgtgtgtgtgtgtgtgtgtgtgtgtaagtcagaggacaggttttttaggtcagttctctcctactttaaggtggggcaagtgcctttatctggtaagctgtctcacaagccccaaactagactcttaccataccctaacacaaaccactatactcagggttcatcagtgcatcttcatgtactaagattctcaccattcttgaggctctatctcagctccacaatacattacagacactcaccacacaaattctgctagatttatcttgtagacttggcagtgtagagttctagccagtttgtggcatttacggtagctcttaataaaatgttcaaagaatgaattcctgcttcccctctcttgtggaactgttacgacaaccgctccatatcacaagtacaaagacttcttttgcaatattttgtaaagctggctagcaagttctctatcaccagtgtggtaatttctaatatagcacagtacccaaagcacagtagatgcctaagtatccagagagttaaactgaatttcacttcatcttataaattaaattctcattttgtttactgtgttcaagtacagctcagccctttaaatatatgttattatttaacctgtccataaacccatgtctattttcagtcatttcgaccttatctcatttgctatttcttggttaagagagacaatatccaaaattccaaaaaagaaaaaattagaaaattaaatgtctatagaaccataaaacaagcaagagagcttcagaacacaaagaactagaaaatacatctgcctacaagttttgctgcgtttttctatgaaagaatatgagcctggtattgacagatcttccaagttttcaagacaagtcagaaattcagaagtttgtataaaattttaaagacattaccaagagattccttccaataatctccacctagttctcaatcatttttaactaacctgagagccaaatacatgtggcaatttatttaactatgatgagtccctactcagtgccaggtgctggaaaatgagacatgaacagtagctataaatagcagctaacatttattgaacattttgtaggtgccaggcactgttctatgtgttacaggaattaatttaacccttttaacaactctactaagtaagtactactatctttattttaaagatgaggaagctaaggcacaaaagttacataaatctgttccaagtcatgcaattagtaaacagcaaagctgaaattaggaccttagattacacccaaaaacctaccatttgaaagcaagcactattcaatatttagtactgagatcactgattacacatagataaaataatgaaactgcatctcacctcatcccacacacaaagtggatcagagatctaaacattaaaggcaaaacagttgagattctagaagataatgtacacagtaacttaaaaatcctgggagaggatatgattgataaaactgaaagtaaaattccaaactttcagcaaccttaaacagacttattttaatttatttaaatacttttatgtgtataattgctttgcctaaatgaatgtatgtgtaccacatgtatgcagtgcccagggagaccagaagagggcaccggatcccctgaaattagacggttgtaaaatgcaaagtaggtgtgggaaactgaacctggatcatgtgcaagagcactgagtgctcttaaccacccagccatctctccagcaccctctcaccttttttttctccccaatactaaggatcaagcccagggcactgagtatgccaggcaaattttgtcattcagctatgtattctcaactttcggagttttaaaatatatattacaaactggaatatgacatctgtaatacatatatacaaggtttaataattagaatatgtaaagaaacacttccaaaaataatacaataggaaaatatatactctaactgaacaagccctagctaggtataaattgtgcaaacctaacactaccagagttaacccattcagcagactctggaacagtcaatttgctatcactgaacaataataaataatcagggctctatgtcatgttgcaggtactacagagtaggaggggaatccagcgagaagagcagaagcaagatggcaattctccacagttagagaaactggatagcaagtagagggtgaacagctaatgcatcaaaagtagatcaagtgatgaaaaacttttttaaaaaggtattttcaactttgtgagctgatataaattctctgccacaactgctcaattcagtcactgggagcacttacagccatagatgctatgtaaatgagtgtggttgtattccaatgaaacattacttacaaaaacaggtggttggcaagatttgacctatgagctagtttggtgaatcttaatataggaagctataattcctacactctaggaacactttctgcatcttattttactttttatgtccgctgacacctaatttttctaagcaaaaactatactacacttaacagcttttgaatggtaaaaagcaaaacaacaacaacaaaaacctctcttatctgtgacaattttccgatcatttttatttcactgaaaaaaaatgtttttgacaatcatccaaactagttttaaaatgccccttatcaatcacagtatcagttatccatacctagaatgtctaactccgctcaaaatccactctgaaccttaatttaggactttattatttctttcctttctcttcagtctatcattcatatcttaaaagaacatccattgtgctgagaagctagctcagtccttaaagttcttgttttccaggcatgaggacctgagttccatcccatgaaccaattaaaacaaaatagacaacaacaacaacaacaacaaaataggcaaaatgcctgcaatctcagtgctgaagaggcagagacagacagaatcctggggtttgctgggcagctggccaaccctacttggcaaattccaggccatcaagagaacctgtggatagatgaatggatggacagaaggaaggacggacggacagcaggcaagcaggcaggcaggcagatacggatgcatgcaaagttaaatagtgcctgagaaatgacaacagagattgaactctgggttctacatatatgagcacacatacacacacacatacacacaaagagcacccattcaccttttaaaaattaaaccttataatatactcctcctgtctaaagtcttgtctcctcctcacctgaagagggttcaagctaacctcctcagtcacacctttaacagctttcctcatctcgtctctcaccatacttgcacatacactgtgctccaccttattcaaggtacatgtctttgaaattcaagttatctcattcatcactacatcttatttttttaatgtgctggtaacaaagtaaataaagggctcggaagatggctcaggtggtaaagtgcttgtcacacaagggcataaggacctgaattcaaaaccctagtccttacataaaggcagcatgctaacagtgcacatctgtaaccccactgcttgagggtaaagactggcagatccctggagctccttggctagtcagcctagctgaatcaataagctccagggttagtgagagaccctgtctcaaaaaataaaatggttgagactgtaaaatggctcagcaggtaaaggcactctatctgtcaatcctgatgacctgagttctggcatacccacataagtggaaaaagagaagtgatccccacaagttgtcctcagattccacacacatggccccacacacaaataactacagaaaataaaatgtcaaggtaaaaaaataataaggtagagaaacaatcaaggaagacaccaaagtcaacctctggtctccccatgcatatgcacaaactcgataagtactactcctccacctcctccacacacacacacacacacacacacacacacacacacacactctgcaaggggggaatagttcagtattgcaggcttacctagattgagcaagaccctgagttcaatccctaccaccacattcacaaataggtgtacagatacttcagcataaacaatttttatacttagtaactatttgaatgtaactagtttcctttgtaatcaatgtcatttactttatacaattaaaaatattattttgagagatccatgctacagggaccatggcacacataagatcagatctctgcattagaaagactcagaaaaattggtactgaatatacatgtggttttgaaaatccttataaaattcttttgattaaactccatcccttttgtgctgggaataaaaccaaggcccttatgttgtatgctaggcaaacactctaccatttaactacaatgccaacacctgaaagtctattttttttcctctggaggcagggcctttactctatagcccagactctcctgcctcagtctcctatgtgttgagatatagatgtgaaccaccgtgcctggcttctaagtttgttttgttttttaattatgtggagttttgtattgtctgtcattccttggtatatccatgggcaatggattctaggacctcctaggatatcaaaatcattatataaagtgatacaatatttgtgtatcctgtctacctgtaatagccaataaaatgtaaatgtcatgtaaacagttgttaagctgtctagtttagggaataataataacaagaaaaaataacagtgacaaggaaaaaaccctgtatgtttagcacagtttcaattttttgttttatgaatgtttctaatcggtgattggttgaagctgtagatgcaaaactcagggacattaaaagtcaactatatatcactggctgatttatctcatagtccatttgaactctcaattgcctatttataacagaaattcaattaaagtgaatatgatggggaccctaggtctctatcattatccttttttccccttttaagctttttgtgttcttttgctgtgcaataaacatccagacgagggggaacatttttttaaactctagaaagaggttctttcttgatgcttttttttttgtatcaatggagatctaggaaatatccaataattgattatacatttttgtatcccactcaggctttgtactgacaaacttgttaaaacaaaaattaatgactctgataatttaatggagtttgacttagcaactgaatgaggaagccttagtccatatccaggagcctctgtcaccgacacaaactatcttaggaaatcaattaccttggctaaaatcactacttgatttgaaaccatggcatgatctctgtaaagccaccgtagttattacatgtcctttccttcttcacgattctgactagtttcaacaagacctttcagacgacctccccaggtgaccctgctctttaagcagcggctgtccccttccaggaaacacactttgggtcaccgcccccaaacagccgggtccctccttttaaagacaactccttaagttgatggaggttctctcctttcctaccagttccactctgtaccttttgctgtccagctcctacatccagcccctgcctggcaccctttctttcctcatcaagctcttcccttttcctgttgctgcctccaacgggactggaggctcctcagggctcacaggtcccgagacccttgggagtcataaagactggccattcagtgccaggacccttccaggctgattcccgcgtcggtgacccactctgatccccgagttcgcaacccccattcctaagcaatctcctccagcgcacgcaaagaacaactccagccctgacagccaggactcggcccccaagctgcctcccctacccctggctgctgctctggggctcggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgagcatgtgagccgaggtgctgggtgcgatcttggtctgcgtgcatgttcagcgctgtcccagcggctggctgtgtgtgctgcgtaacgctccacgcctcagtgtgctctccccagctatggggatgatagtatttccttgcgcagaggaaatgagggaaaggcttggaaagcgtctaatgactgacgataaagataacctttattctatctcccccccccccacttcgtcccaccaccctaacaaacacggtaggtgctcacaaaatagaactggtgagtgaacaggtggaggcgggcctctggcttcctctcttcccaaagcagggaagtgttcttagcactgggctgagcccagagtcacttaaatcagttcccaccccttagcttcatgattttctttacctctgtgtctcagcttcttcctctgtaaggacggttggggcaggtggattcttaacggctcagttatagtgtctcatctaagagaggactctgaaacgctttctttccacgggtatttattgagtgcacactgtgcacatagactggtatgggtaccacccttaccagcaccgccagcgtgcgccactatttttcttgctagtaatattcctccgtcagaattctgagcgtgccactctcttactaaaaatgattcgacagaatctaggggtgtgtgtgtgtgtgtgtgtgtgtgtgtgtgtgtgtgtgataaaagctgcagagtgagaactatttgagggcagaagggatgggagaggtaatgcgaagtaactataagcgtgatacgcatgtatgaaaatctcatgatgaaacctattaataattattttaaagatctatttatttttatgtgagtgtttttgcctgtgtgtgtgtgtgtgtgtgtgtatgtagcacatatgtacatatgttctccacacgtgtatatatgtgcaccacacacttgtgcctgaggcctgtggaggtcagaagaggtgttgggtcccttggaattggagttacagagagttgtgagctgtcatctgggttctgggaatccctgggtcctctggaagagtggccagtgctcttaactactgagtcacctctccagtccctaaaatcattttttttaattaaaaaaacccaggcaggcaagattggttaatagataaatgcacttgtttatcaaggctgacaagctgagttccctcagaagctcacacgacaggaggaaagaaatgactcccacaagttgtcttctggccccttagcatgtatatgcctacacacatgtgtacaggcatacacacacattaaatttttaaagatattttacttggtatatgagtgttttgccagcatgtgtgtgtgtgtatgtgtgtgtgtgtgtctgtgtgtgtgtgtgtgtctgtgtgtgtgtgtgtgtctgtgcgtgcgtgcgcgcacgcggcataccatgcacatacctagtacctgcctgtggaggccaaaagatggcattggatctcttggaacagcagttatagatgtttgtaagcctccatgtgggtgctgggaactaagccactggactatctaatgccatacagccattttttattgttctatataatatattttatgtatttcttttttatttatttttttttcattttacgtaccaaccccagttccccctccctcctcttctcccactcttccccaccttccctcttcccacctcctatccactcttcagaggggggtaaggcatcccttgggaagtcaacgaagtctggcataccaaattgaggcaggaccaagccccttcctgctgcatcaagtctgagcaaggtatcctaccatagggaatgggtccaaaaagccagttcatgctcctgggataagtcctggtcccaccaccagaggccccacaaacagatcaagccacacaactgtcacccatattcagagggcctagttcagtcccatgcaagttccccagttgtcagtccagagaatgtgagctcccactacctcaggtcagctgtctctgtggcttctcccatcatgctcttgactccccctccttgctcatatgatccctcctctctctcttcaactaagttccagaagctcagcccagtgcttgagtcatgcatccatttttaaaatgtaattaaaaaattttaaacccattcaacacctctccatttctcttaagctaaaggacaaacaaatctctccctggtgcagtcattgcatcaccagtcttattttggggtcctctttccttccctctggctccctgtacatgctgatcccactgcctgagattctctctcacatagcgaaccttcatgtcccaggtcaaacatggctacctcacggatatgatctctccttgcacagattctcttggcagcatggacttatcaactgactgcactagactgtttattatctttgccactaggctggactcactatgttggctgctgtttctgctgtaaatagcacgatgtctgttagagagtaggtactgggtgagtatttatgtggatcccatgtgtcattctatgtactaggctcaagatcttaaaaagatggagagcaacaggcaggccaccagggtctcgcttatgtagccccgtctggccttgaactcaaagattcatgtgcctctgccacatcaatgctgggattaaaaagcatgtacaaccactcccaagccttttctttgttaaaaataactttttatcatggtattttaaccacacaacataataggtttcattatgacattttcatatccatgtatgttatacttggttcctatttactccatgtcattctctcttgtaattctccttcctttctctggccccctttctcttcccaaatagtcctctttctacttgtcatttttttaaaaaaaaaatctaaattctacatatgagagaaaacttgcaatattgtcttttctgagtctggcttattttacttaacaaaatgatctctagttgcaatcactttccatcaaatgacatggttttattctttcatttttatttttaattcattttaactttacatggatttagctagggagagggtgcttgcgcctctgtgtgtgtgttgtggggagggtgcccaaagaatctagaagagggcttcaaattccctagagcagttgaattcgggtcttctgaaagagaagctagtgcttttaactggtgtgtcatgtctccatctcctatttttatttttattttttaaaacaggacatttatatattcctagctagcctagaacttattggacccaaactcatggagatctggctgcttctgcctctcaaggattgggattaaaagtgcacttctatattcagctgatttcattctttttatgactaaataatacttaattatgtattgcaagaacttgggattctagactgattacatagtttgaccattgtgaataataccacagtgaacacgagtgtgtgggcatctctgttgtatattaactttgactctttcttaacttattaatttttttttacattccaatcccagtttcccctcactcttctcctcctgctcccccaactctcccatctgcttctcaaagagggtaaggcctcccctaggaagtctactaagtttattccatcatcatcttgagacaggatcaagccatggctaggctgagcaaggtatctctccatagagaatgggctccacaaagtcagtttgtgcattagagttagatcttggacccactgtcggtggcctcatatattgtcccagctgcaccactgtctcctatattaagggagtctagtttggtcttatgcaggttccccatttatcagaccagagtcagtgatctctcactagctcggggcagttgattctgtggtcttgactccttttattatcactcctccctcactttgattgtactccaggagctcagcccaaaggttagttgtggattcctgcatctgcttccatctgtttctggaagagggttctaacttccctggggttgtgaattgtataggctgtgtatcttttgctttatgtctggtatccacttatgagtgagtaaatactatatttgtcttcctgggtctggattatctcacttaggattttttttttagttctgtccatttgcctgaaaatttcaggggtcagtgtttcttactgccaagtagtacttcattgtgtaaatgtatcacattttctttatccattcttctgttgatggacatctaggttgtttccaaattctggctattacaaataatgttgctatgaacatagttgaacagatgtccttgtggtgtgaatgtgccttctttgggtatatgcccaaaagtggtattgcaggatcttgaggtaggttgatccctaattttctgagaaatcggcatactgatttccatagtaactgtacaaatttgtattcctaccagcaatggaggagtgttccccttactccatatcctttttggcataaactgtcatcagtgtttttgatctcaaccattctgatcagtataagatggaatctcagagtggttttgatttgcatttccctagtgactaaggatgttgagcatttccttaagtgtctttccaccatttgagattgttctctgtttagatctgtaccccatttttgaattgtattatttgttagtttgatgtctagtttcttaagctatttgtatattttggagatcattcttctgacagatatggggttgaagatcttttcccattctgttggcagccattttgtcttgttgactatgttctttgctttacagaagcatctcagtttcaggaggtaccatttattaattgctgctctcagtgtctgtgctaactggtgatctatttaggaagtggtctcttgtgcctattcattcaagggtattttccactttctcttctatgaggttcagtgtggatggatttatattgaggtctttgatccatttggacttgagttttgtgcatggccatagatatggatctatttgtattcttctacacattgacagccagttatactagcaccatttgttgaatatgttttcttttttccattttatatttttagcttctttgttaaactttatgtgttcataggtgtgtgggttgatatcagggtcttcaattccattccattggtccaccttggtttttatgccaataccaagcagtttttattactatggctctataatagagctttgaagtcagggatggtgatccccccatatgatcctttattgtacagggttattttggctatcctggttttttgtttttccatatgaagttgagtattgttctttcaaggtctgtgaagaattgtgctgggattttgatggggattgcattgaatctgtagttaaccttgattcttttagttaggtttacataagagttgtatagctgaatcatatagcagaccttttattacctgtttgaggaacattcacactaatttccatgatgactggattaatttatgttttcattttataaaaagttgtaatttatatacagtaaaataaaaaaaaccttacacatgtacctaatatttttgtggtcctaggaatttgaactcagcaccttgcacatactagataaatgctctcccactaagctatatccctggtgcacataataagtcttttacttatgttcctgtggtaccaccactccaatcaagttgcagatcagttaatgcatcaagttcccttttgtttccttccagtgaatgtccatcccattagaagtaagagttatccaaatttctagcatcataaacttattttgttaattttgggggctgggcattggtggtgcatgcctttaatcccagcgctcgggaggcagaggcaggcagatctctgtgagttcgaggctagcctggtctccagagcgagtgccaggataggctccaaagctacacagagaaaccctgtctcaaaaaaccaaaaccaaaacaaacaaacaaacaaacaaaagatttgaagtgatgagattgttagtgcatatcaaacatggagaagatgaactggtgccttaccagacacttcacccctgccgactagcatttatggtgttggaagtcactctgcaggatacagagaagaatggtaatcaccaatccagccataaacctacaatagtgacctccctgagagatatgctggtatagcagcggcacaaacaatgtgggagtaaccaaacactctctgattggatttaaggccaatgccatgaaatggaagccatgcctgacacttcaacaaccggccacagatctaagggaaaaccaactactgttgttgtgctgaaggaacatagcgacaaaatgactcctaatgtggggctggagagatggctcagtggttaagagccctggttgctctttcttccagaggttctgagttcaattcttagcaaccacatggtggctcacaaccatcaataatgggttctgatctcctcttctctctgataccctcttctgccatgcaggcttgcatgcaaattacataaaataatgaataaataagtcttttaaaatatgactcctgctgggtgttggtggcacacacctttaatcccagcactcaggaggcagaggcagttggatctctgtgagttcaaagcaagcctggtctacagagcgagttccaggacaggctccaaagcaatacagagaaaccctgtcttgaaaaaccaaaaagaaaaaagactcctaatgactttcttctatatccatagatcagtgctttactcagtcatcaccagagaggcttgcaatagatgggaacttacacagacccacaacttgacaatttacagcgagtgagagatatattgcagcattcagtactaaatggcatgtcttcatcaaaccctccctgtagggatgagagactgtgagaagggaggtggaaagattataagagccagaggggatggaggggtttaaagaaacagtgtcttccctccagacacaataggaccaatgcatatataaactcacagaaactgtggcagcacaaacagggccagcacagattcaagctagatgggatctcaggatgacatggggaagtggacacaggctcctactcctaaccaaggagctatctgcaattgataccagcttgcaaaagaaaaattagtcttctaaaatgggatctcactggatatagtggctcatgcccttttaatcccagcacttaggaggcaaaggcaagtggatctctgtgagttcaaggccagccagagctacatagtgagaccctgtctcaaaacaaagcaaacaacagacaaaaaatatttgaatttagaatttaattgggaactggtgatgactgtcagcaataaatctacatcttgtgtggaaaaaataacaaataaggttggagcaacaacatctcactgttttcagggccaaatgacgtttagttgggtgagtagtgccctataggacattgtaccgtgctagttccttgatagttgaccagtaggtggcagtaaagtgccttgatacacagtcaaatgaaggagtgcctccttaagggaagcactattttatataaaatttatactataaatgcttaacatgggggaaaatggaagaaaggattaaaatggaagaaattgataactacatgattgaaaaaaaactgaccaccgtcaagaagtgacctccctgaagataggtaatcttagaattcaaatatctgtttttaaaaatgatctgaaattttaaaactaaaacaaaaagactttatttttatttcacatatagagtgttttccctgcatgtatgtatttggatctcatacatgcagtgtctgtggaggccaaaagaaggcatcagattccttggaattggaattacagttatgagactgagtgtgggtgctgggaaccaaatccagatcctctgcaagagcagccagtgagtgacctaaacccctctgaaacagttcttgagttccctgaaaattttaaacttcaaatagcaatgatataaaggcacacaagtgtacaaatcataaatcttatgagtcttcccaaagtacaacacacgtccagtcagcacccacatgaagaaataagaaatgggctgcggagacagcacagctaccaagcctggtgacctgagctccagctctggcaccatatggtagaaggaaggaaccaatttgtgcatagcacgggagcaggcacacatacacacacacacacacacagagagagagagagagagagagagagagagagagagagagagaagaggagaggatagggagaaaaggggagggcgaagggagaagaagaggtgtgagaacatgcattatgagcaccataaatctactttcaaggccggacgttggtggcgcacgcctttaattccagcactcaggaggcagaggcaggtggatctctgtgagtttgaggccagcctcatctccagagcgagtgccaggataggctccaaagctacacagagaaaccctgtctcaaaaaaccaaaaaaaaaaaaaaaagtactttcaagttaccttctagaaattactaggagtccccttagggtaaacagaattctaacgtctcactctacagattaggcttgacagttcagttttacatgctgtaaatgcactcacacagaaggtagtctctgaatctggcttctttggctcagtatttatatttttgagattcctctatattgttgcatatggttgtaatttatcccatttcgttgctgggtagcctttcactatgtgaatatattatggtttaccagttctgctgctgctgactgcttttgggtttctcactttaaggacagttttgtttttgtttaagacagtgtctcactatgtagtgctggctggcctcaaattcacagagacccacctgcttctgcttcctaagggttgggaggaatatctagcctgacatttttgtgcatggaatagcctaagaaatatgcttcttttaaaaaaagttttttgtggggctggagagatggctcagcggttaagagaactggctgcttttctagaggacctggtttcaattcccagcacccacatggcagttcacaactgtctgtaaccccaattcccggagacctgacaccttcatacagacatatatgcaagcaaaacaccaatgcacatagagtaagagtaaataaatcgttaaaatatttttttaaaaagttttttgcttgttttgttttgaaaagcctctctgtgtttccctggctgtcctggaatttgctatgaagaccagactggcctcagatttacagaaatccacctgcctcttcctcctgagtgatttttttgttttgttgttgttttgttttgttttgtttgagtctgttcttattttatatgttttgcctatatttagtgtgccatgtgcatgcagtatctgtggaggccagaagagagccaaaactggagttagagaaaggctgggaacaaaatccaggccctttgctagagcagcaaatgcccttaatcattgagtcatctctccactctgttctgttaaagcttgttaaagtggttgttccagccactgccgacaacacagaactgaagtacttgctactgctgaattgtccgtttctcccttcatttctgaatgttctgcttcatgtatttaagaccttgccccttatgtctgacagttttgtaagtgtatatggtgagttttagtctccactctattatccgttctgatgctacatctttctccccgacagccttcttctttcccacaaatcccctcctacttgcatgtcttttatgtgtatgacccaatgagtttaattagggtcgccttcatgagcataggtggatggaagattgcttcatgtttttgattttttattggcgtgtggatggtgggtgtcatacatgcatgtgagtgtgtaggccgtgtgcccatgcacatatgcaaacagagaccaggggaagacatcgggtgtcttcctccatggttcttcattgtatcactctctcactgaatcaaaagttggatgttttggctagactgacgggctagtaagcatccaggatccacttctctctaccccacaatgctgggttcataggcatgtatagccatgcccaactttttacatgggttttggggattcaaactcaggtcctcatgtctgcgcaacaagtgttcttacccacccagccatctccccagacctatccttcatagtttttaactgttagtaggatatgtgtatatgtatatgtatatgtatatgtatatgtatatgtatatgtatatgtttgcctgatgggttgattctcttatctttacaaaatcatcttgatctctaagtgactttttgttttacagtctattgtgtctgaatccaatactcccagttccctttttttctcctatcttcctctttttttttctttcttgatagtttttcattctgtagctcaggatggcctagaaatcactttgtagtgcaagctagcttcaaactctgtgtgatccccgtcactatctctggagtgttgagataataggcatgcaccaccaaagctggatcctgtgtacatgggtattttgtgtgctcatgcacgtgtgtgtgtgtgtgtgtgtgtgtgtgtgtgtgtgtgatgccagattcaggcagaagcaaagagcaagatcctggggaactggggttacaggtggttgcaaactaccatgtgggtgctgggaaccaaagtcttcctccggaagagctggtagtgcagttagccactggggcatctcgccagcccttccttgtggcaataccttgtttgtactctaacaaataaagcttactagttaactagtggagctagccactagttaaccacagaggccaggcagtggaggcacacacctttaatcccagcgtttgggatctcatgcctttgatcccagtacttgggaggaggaaaccagaagtcatgtgagagaggaacataaagttggtagacacaggagctagccccttttcagttgcctgctttgcttctctgatctttcagtttttcacccctaatacctgactctggatttttattattaagaccaattagaactcgtgctactgttccttccttccttccttccttccccttccttccttccttccttccttctttccttttttccttccttccttccttccttccttccttccttccttccttcctccctccttccctccctccctccctcctcaccttttttttttcttctgtttttgagacaaagcctcactatgtagccctggctgaactcactatgtagatcaatctggcctcaaactcacagagatccacttgcttctgcttcccaagtgctgggattaaaggtgtgcaccaccacactaggcctctaaattttttatagtatattcacatgagatatttttcctcattattttagacctatttgtatttttgagtttgaagtgtgtctatttatggacattgaactgctggatcttatttttctacccaaatgatgaggttccttgaccagtttgttttatccatccatatttaatgatactattttgcagtacaggggctcaaacccagaacttcatgcataccagacaactgtcttactacagaactacatccccatgtatttattgacttgatgaatctttgaatgatgtaactggcccagattattttcttctaattgtggaaatatctctgaattaaaagaagaatttgtaagaatcaggcctataaaattgattagtgcagtaatgatcatttagaactctccttaatattaacaaaggactagagatcctcaaatagctcatctcagttgataagagtgcttgcctagcatgtatgaaatcctaaattttgtccccagcattacataaactaggtgtgatgatggcatatgactataatctaagcacttgggaggcagaggcaggaggacagaagttcaagattgtcctcaactgcacagtaaatttgaggccagcctgggacactgcctcaaaaaaaatggtaagggaaataccaaaaatcaataagcaagtacttttaactttattatttgaggcctcagagaatattgcaacattcttcaaagttccaagtctcttatttcatttcatagttagccagttatagtcttaatatgagacaaacttttcaatgttccttatgccatcacaagacagtacagtctaaataaaatgacagtgattaggaacagaggatcttggtgtgcaccaatcttgtctttgtcactggtgtctccagtgccttgggccatgcatgacagagtagacacataataaatttagtggaataaaatttaatgttccacgcattcaatataccgagcaataagggggctttcccttctctctctctctctctctctctctctccctccctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagacacttgctgtgtagcccaggctagccttgaagttatgatccttctatctcagtctcccatgtactaggacagtattgaaacagacttcccaagtcatcagaattttaacattcaggaatcttagctggatgcagtggctcatgcctataatccaagttcttaggaggcaatggcagaggactgctgtgagttctagcaggcagagaaggggggaaggtggcaattgtgaaaatacagttccatttttactttttaaatataatctataaatgtgtagaaaaagagaataacatgtgctaagttactgacagtgctattcttggaaagtgagttctttaggagggtagatgaactaactatattatatatttctgaaatatctgatatttgaataattgttacatctgtaatatatgaggcatagtatagagcttattgtgatgatattgtaccttataggtatcattagttccttttgcttgttttgtatttggtggtggtggagattgaaccaagagcctcgtgcctgctggggaagcgctctctaccactaagccacttctgctgcccagtgtctctcaccttactgtttgtcttgtttaggactgaggtctagggctggagagatggctcagccattaaagctaggctcacaataaaaaatgtaaggactgaagtctattgcctgaaatagtggtttgaatgagaatggcccccatgggctcgtatgtttgaatatgtagtctccagttggtggaactgtttgggaaggataaggtgtggtccttgtgagaagagttgacactgggaaccagctttagggtttcaaaaatatcccaacaattcctagtgctgtttcttacctataaatcaaaatgtgtgatctcagctgctgcttcagtcacctgttggcatgctatccctctgacatcataaaatctaaccctctggaaccataagcccagttaaactctttttttttttaaagattttatgtatttattatgtatacaacattctgcttccatgtatatctgcacaccagaggagggcaccctgcctcattatagatgttgtgagccaccatgtggttgctgggaattgaactcaggacctctggaagagcagtgggtgctcttaaccactgagccatctctccagccccccagttaaactctttaagttgtcttgaacatggtgtttttatcacagcaatagaaaataactaagacaggaagtacaaatggcattatctatgaaagatacttgtctgttatgtgaaatattgttcatagcaaacaactcacctagtagttgtgaaacaggttaagaaaacgagttgtagagtcagacatcctgagactgaacccaaccaagttcttctgtttaataggtaagaaactttggacaagtcctttacatgactgtttgcccatatccccatcaataaggtgacaatagtatttgtacctaactcatgaggtttgtgacaaagattaggtaagattattctcataaagcacttagcattaaatgcttgatagatatctacaatgaagttattattttttattactagcacaagttttggaaacacaacccctgaaagttgatttcaggttgtccttgttgtcacaggcttctgagatggggtgagccaaggtttcctctctcattcccaaccccacatgtttgagcatttggtccttaggtgggcatgctttgacatttttggaggttatagaacccctgaggaggacctagctggaggaagagggtctctagagaataaggcttgagatttaattactgacacccttatcctgatgttatctctatttcctggtctcccttaggtgtaagcaagtttccctgtcatagcttggagctgttctgttgccatggtgtctttgcttgagggaccagatcctctcaaactgcaagccaagttaaatcttttctctctaaagttgcatcttgtcaggtgttctatcaaagcaatgaaaaagcaattacaacatcatttagacagagatcaagccagagtcatggttaagcaatattctttctttaattcccctttgcaaatggaagcccctgagctgatacccacccccacccctacccgactgcctggggaccttcaagtgcaaggcccctgccttaacctggtggacggggaggattacctctccctatgatggcctatttaaaaaaatcctagtcacttaagaaatggggccaggtacaggaaaagggagctggaagacaaggcctagatcagaccagtctgaaggtgttggggttgtgagacccttgagaagggtttacaagcacatccctaagctcaagggcagcatggctgagataggagaagagacagacagacaatctgactcctcaaggtcctgcctgcctggtcatggacactgacgtcaccattaccaccaaaggccttcagttggagaattttccagttactctgggatagggtttgctaagcatcccctctggcccctgatctgaggcatccatggggtccccctgagaccaaacctgggagaaagagggactctgggaacatgcaaaggcggagaacagagatcccgcccaccccaatgctctacaggacggtggctccagctgcgtctggactccgagggtccttcacaccgatgatgaagttgttggttctccgactgccgtggacccaagataagacatctaccttctccacatggtgacccctggcttccaggaattcaatctcttcctcggtgaactcacctgaaaatcatccccatggcaacatgcacttagagtactgatttaggaacctcaccatcaggtttcactttaacagcaggaattttgtgaatttgcatcctcacggacaaaatggaggattgtggacaacctaccacataaagttgttgcagggactaaaggaaataatgcataaaaaggactgagcttggagtcttgcacacatccagggatccatgataagcaatcgttcttctgtttgtttgttttgggggttttgtttttttccagacagggtttctctattatgtagttctagctgtctgaaatttgctatgtagagtaggttggcctcaaactcacagagatccacctgcctctgccttctgagtgctgggactaaaggcgtgcgccaccactgcctagccttagcagtcattcttttattgtttgtttgtttttcaagacagggtttctctgtgtagctttgtctgtcctggaacttgatttgtagaccaggctggcctcaaactcacagagatcctcctgtctctgcttcccgagtgctgggactaaaggtgtgcatcgtcaccactgtctggcttcagcagtcattcttaataatggcaaaagacctgaactctatctccaagtgccaccactgcttatgagggttactgaacggccgacttaatgttcattcgttcgttcacccagtcttgccttctttacagctacacacactagccaaagctatccttctcccactcaaaaccctccaacagctctgataggtcttaaaataaaattcaatgtccacctctagggcccactgtcagctggaaccccagtccctctttaaaatcttctcctgagttccttctattctccaccttgcttaactctgttccagccatactagcacccttgctgtctcttaagtacaaggcctttgtacctgctactgcttcatcttggaatgcttaccctggagagtcacgaagctggctcctttacttcattcctgtccttggccaaaggcacctcttcaagaatttccctattatctagaatatcagtatctgccaggtttatcctgcttcctttccttccttccttccttccttccttccttccttccttccttccttccttccttccttcctccctccctccctccctccctccctccttccttccttctttcctccctcccgccctccctcccttccttctttccttttgaaataggtgtctcatgtagccctggctgacctcagactccctaggttcctactagttgagatgaccttgaacttctgatccttctgcctctacttctgagtgctgggattcagggcaagcaccacaaggtccagtttaatatggtgctggactagaacctagagcctcacgtactttgagcaagcactttaccaatggtgctacctccctagtcatatcatgctagtttgttttgtttgagacagtctcacggtgtatcctttgctggtttagaagttgctatatggaccaggctggccttgaactcacagagagctgcctgcttctatctctcatgtgctggaattaaaggtacacaccaccgcacctagcactccctgcttttccccaaaagtatttactactgtttcaactgattaactgtattttcttaatttcaagttttaaaaagcaggttggcttgtttgtgattgcttcctagtgcttagagaaggtcagcacattgtaaaaattaagtctatatttgcaagattgtagttgcttaacctctgggttgagttgaggttttcatcatctcctgccctgagccatatcccatgtttgtatctagacttatgttctctcttcaatccacctcccctacctaaagcaaatcaggccatacgtctgtctccagctgagtgcttcttaacatagacctcaacgaaagcctagtttatgtcacttcccttactcctttgcaaagatttggtcttcttatgttctcaaacagaatgattttaggtggttcttaagaaaaggcattattgttttatttatttgtttgtttattttttgagacagagtctctctattatatagctctggctgtcctggaactcactatgtaaatcaggctggcctcaaactcacagagaaccaccaacttctgcttcctgggtgctagcattaaaggcatgcaccaccatgtatggccactaaaaactccattttactgagtatcattaagttatcacatcagaaatctatttcctttgtggtttacttttcatccttttgattatggcaagtatcaagtttcaggctggtatctaacattttctgaactcttatacaatgagagtgatcctccaggccttctgtagacagaaccacctaacaataacctcaacatatttgacttttaagtaactattcatcgtctgtatgttgcaagtgatataattttcctgtttgtgatttaggtttatgttcaaactatacttagttttaaaatgaggggttgctggagagatgcttcagtggttaagagcactggccactcttcccaaggacccaggttcaatcccagcaccaacatggcagctcacaactgtctataattccaactccaggggatttgacaccctcatacagacaaaacacaaatgcacagaaaatataaataagtaagtcattaaaaaataagttcatctgtgagattatgttcagggtgatgtagcattaaaaaataagttcatctgtgagattatgttcagggtgatgtagcattaaaaaataagttcatctgtgagattatgttcagggtgatgtagcattaaaaaataagttcatctgtgagattatgttcagggtgatgtagcatttgcgaagtagcaaaggtactagctaggtaaactcagaagcctgggaaacagctggtcttactgatgttttcccacactgttctttctgggtttttcacagattgttcctcctgtccaaaaagccatttgtcacttcctgcccaattcccactcctaatccagtcagttaccacctcctctgtgaagcctcccagagctaccccctggtagatttctaactagtttataaccagttgtttataaccagtttctaaccagtctctaaccagttatttctaaccagtttataccctccatgagcttctctgtctgcaaaaaagtgatggtactgactaagcaagggctgcctccatcacttctggatcttcttggaacaagcagattgattgtaataactactcaaaaatgcaatgttttcctatttataaaactaaaccgtacccaaaattaagcttttgttgttaggggcaactctatctccttaccataaaccgctgaggttcatgatctggtccctgccctcctctttgatcttagcatatatccccattcaccttggtctcttttatttcttaaaaaacacgaagcccaattttgctctgagttctctgcacttgttcttagtctacaaagctctgccccagtttttggcatggtagggactttctcactcttcagatctcagcttagatgccaccaaagagaagccttccacgatccctgtaggtccaattatatcatcctgctctgactctgcgccaaacttttctcttgctagctcacatttctctgattgtttttctgtctgcctgtaaatccctgaagctgggatgatgcttggcacatacaaggtcttcatcatacaccactgaatggaggtttgcataaaacagctattatctcattttatgcaggagaaagtgaagtctcaagagttgaggcatggatttcctaatgtcacaaagtcaggaaatgccaagatggttccaggcttcagatcttacattagccctatagaatttgtcaggggacccccccccaaaaaaaataacttcacaaaaaggaagttagtgctggtcaaggcaggagaagctttgggatagcccttctccaccaatccctgtgcccatccttaggaatttgctctgcacttactgtccacctgcaggaggttggactgcaggtctgggtggaggcgtcctcgggccaggctgtcacttaggtttcggttcaatgttaggacattcagtagaacctgtgggaaaacagagcaaaaacatcagcttctctggggacaaaggttcaagacttcatagctctcatcctcagtccaaactctttagtctttaaaaagctcacacttgatgtgtcatctaactcttccaacagccctggaaacctatgataactgtccccattttacagaggaggaaattgagagccatgcaactcctttttagagttgaaagaagaggtactactagcattagtcttctataatctagccaagggcttccttttctctggagaaggcagggttaacagcgtgatttagtattcaatataggtagtttcagcttaatggttaggggttggaaagattctgaacttcctacccaatgctactagttaaatgagcttgagccaaattcttaaccagtctgagcttcagtttccttacctgtaaaatcaaaacagtcattcctcccagagttggtgaaattggtcaacacatacattacagtgcctagcacctagtaaggactctatgatgttagttgttgttacctctacttcacaggtgagggtactaaggttcagaagaggttacgtgattcccccagcatcacatagctgaacattggaagcatttgggttggaactcaggggaatctaattccagagttatagtgcatcacctgtcaaaattatgagcctggtgtgtgccagttgctcaaggcactcttggaactgtcttgaggtattctggggagtagcaggaccttcctttcaaaataagaccccacagagtggtctattaagataagagcaggggatgatgggacttgaggcttacagaacacaggcagtccagatgttaaattacttctgaattctacttgccctgcaatttccccgaaatctcatggagacagaggtctccagggccccattttcactttgaagcccaatcccagaacattgtccccaacacaggcctggtacaatgtaatacagcttgtgattgctgggaaaaagatggaaaacaacccagagataatgtggggcacctgcagacctggctcctgactacaaaatatttctaacagagtaaatctcacctgggtcaggccactgaggcctcgggcagctccgttggcccccagtgcaaggtaggtcccgcagagcccctctgctggtcggactacagtgggcagcaggaaggagaggggccgtttccctggctgtactgagttctcctgttgccagagggcagagatgaaaagggagatgtagcgtggagcaacacagggaaggaaccagttcaccaccattcatgcccactgcttttctcatatatggtccacaggttcagctcctgggagataggtcccttcctagcaacaatgtgctgtctgtgaaagaggaagtgttcctggaagactagagtggtaagagcaagagacttggaaccattgagctatggggcgggtatggatggaaggggaaagacggagtgtagaaaaatggtaatggggacagtaggattcccattggaccacctctgtgtctttgccctataggaagcttgccagagtagaagtgctggtctccaagtggacagatatgcctaagttcttcctcctggcccctctttggtgtccagtcacagatttgagcaccattagcccagcatatacctctagtgctagaaagagcccaagcactaaatggggatcaatggtctcattgcccagagaggaggcaagactttctctagtcacactaagctcatgacagaacggcacaaggattccttagacctaccagcctccatgctccacatttagcagggacagggatgaagttcttaaaggaaataggggggaagaaagacccatggtgctacctagcctcaaggtccctgggagagtagagaagagcctaccaggctgggtgcagagtggttagcagtcctgttgggccaggagaagtccaacatctggctgttgagtaggatcccagaaggagtgatgaggccactaccaaaaggccggttcagggagctgggtgggcagaagaaaggatgaatgggccctgtggctgccttccctgtcacccagcccacttccatcctgcttggaatgatttattgtcattggttctaagcctgagctgacatacctgaccatggccacaatgaagtcatcaggacccatgatcagcacctgggcagctgtgggagccccatccagctcatagacaggaaggagtggggcaggggctgcctgagagtcactgatgtggccccggaagttggcggcctccaccttgctgcaaagtgggtggtagatgaatgagcatacaacaacttttattacatcccacctgtctgtgatgtttgtgtgaatacttagttaagtctgccttctttaccggaatattaagtctacaatggtagatcacactgctaacacataggaaactcccagaaaataactatgaaactgaaccgatttatttaggtgttattcagagtctagagccagccttttattttacttattttctaatcaagagtcgcagttatttggctctattcctttctatgaaaatgtctggggtccagtggatgctctgagatatttgtttggaataaacaagcttgattgatttggtctaatgtttgtagtttggaactaaagttcattaagagtttagttagatggggcccatgagatagctcagtgggtaaaggtgctttctgtacaagcctggcaaccccagtttaatccccaggactcacactaaggtagatggggagaactgactccataaagttgtcttctaacctctccacacacacaagggcaaatatatggcccacatgcatacacataccacacgtcatcatcatcattaaataaataaaataaagttttaaaaaatgtttagttaagccaggtggtggtgatgcacacctttaatcccagcacttaggaggcagacaggtagatctctgtgagtttgaggccagcctggtctacaaagtgagtttcaggacagccagggctggtacacagagaaactctgtctagaaaaaccaaccaatagaaaaaccaaccaatcaaactaacaagcaaacgaaaaaacaaaaccaaaaaaaaacccaacccctgtttagttagggggctggagggatggctcagtagttaagagtaattcccagcacccacatggcagctcataactatttgtaactctagtttcaggggatccgacaccctcacatagatatacatgtaggccaaataccaatgcacataaaacttttaaaaaattaataaaggaaaataaaaagtttagttagaagccagaagtgttgatgaatgattgtaatcttagggggtagaagtgaaagatttttaagtgctaggtcagttttaagtcatttttaagaactagactgtgtagaattccaggccaggcttggctatatagcaagattctgtcccaagaggaggaggagaggatctttgttagtaggttttctgttttcaaggcaaagaaaacacagtaagccctctgctatttactagcagaaatagttgtatatgtttcatgtaaatgcaggcatgttttagagctgaagttttccatgcttaaagcccaactgaggagttctccattattactgctaataacttgtgtgttgggtgttttgtagtgattagggaatggtaagttagctaggactaccaaagacattcactcggttttcaatccaaaatgctgatgaccacacagagtgagctacagagctttgggagggtgggagaggcttagttttcacactttgtcctggatgctttgatgttcattagctttcattgctcttattttagccttgtttggataaatgatactaacttttgtttctgttttttttttttttttttttttttttttttttaacacaggatctttctttctagccctggcagacctggtactcactaggtagactaggttggccttaaattcagagatctgtctgcctctgtctccagaatactggagttaaaagtgtatgtcaccatacccagcacgatattaacttttgctatagtgtgtgcatgtgtgtgtgtgagggcacaaatctgccatgatgcacacatgacatgatgaacatgtggagatcagaaaacaatcacggacatccatctatccttgctgttcactttgagcgggcttttcccattatgtataccaggctggcttttgggaattctatccccacctcaagaggctactagaattacagacacccatgctggcctaacagtaggcctaatgtgtaggcctaacagaagcaggtttttatatgggttctggggattcaaattcaggtccccacatttgtgctgaaagttatttttcccactgagctatctcccctggctccatagttttaaactgacaggtacaattagatgtatttcctacaaaacagcttacatcgtagctcaggtcaacctatgacctagctcagtaacttactgtgtagatccagcagtatttatggcagttctcctgcctcatcatccagaatgctggaattatagacataagccaccagcatgatgttttggtcagatctcactagttaacaactgtgagagtccacagttatcatttttttgtagtgaaaatatcaaacactgtattcttcaaaatacaatacttgtcattaactatagtcaccatgctatgcaagcgacctcttgaacctattcctgctatttgcaactatgcatccctttctctgaaacctctggattcccatctttttgcttttttgtttgttttttgttttggttttttgagacaggatttctctgtggctttggaggttgtcctgaaactctctctgtagaccaggctggtctcaaactcacagagatccgcctgcctctgcctccccagaggcagggattcacgacatgtgccaccacctcctggcatctttttgcttttaaattataagttgctcacaatttaatacatagagtggtatttgagtaacagtataaatttatattaaccatatttttagcttctgattttcctggaccctgactgtaagtcaggtacagtagcagtcaaacaacccattcttacctctatggccaattaataataataaattgcatttattgcacatttactgttccagttaatgtgctaaatgctttacatgctattcttttatttatttacaagttattgtcatgaaaacctcgcagagtggatacaatattgccaggctccttgtggaaatagacttagtgagtttaaattactctcccagagtgacagctagcaaatgttaatgtgtaggcctaacagaagcagatgttaatgtgtaggtctaacagagacagtctgaccagagcctaatctcaccactgtgctgctggcaaaaatacaaccactcaaaagtcccatcaactccagcatttgcacggagactattttgttgctctcagactttccttttctacgcaaagtggagaacagctgtgtccatacagattaggtacatgcagaggtccaaaaggattcatagacagttgactaactcactgtgcagacagaggtgatgcagccagaggcacctagtgtcacactgagttagggttcagctgaaagggccttaagactttgctagttttttacctgatcccttctcccatatctaccccgatttctgcagcacccagggtcatgtcccgggacaaacctgagcatgtcatccatgctctcagtgatggtagaatcgtaggcaggatctcccagtctgctagccagggccaatgcaatcttcaggctctgaaaacatagcagggaggtggaaaaggctgccaggcccctcccagcacccccacttgggagatcctcatgtgcaagaaaactcaaaggtgttttagccctagtccaaggaggtactccattttcccattccttttgttcccaaatccaggtaaggtggaacagtgtgggccttacctctgccacccagtgaagcgcctgctcacgggacaccaggctggtcatgttgaagccctctaggatgttgagagcactgatgagggcagggcctgtgtgtgggggtgggggactgagaaccaggtggcctgaaaggataggaaaggaccagatggcaggagaggggtcaagtcatcttcatatatcacatcttatgtgcacatcccaccattacacacacagcgatagacctgatcaggcgaggaaaggaaactactaagtggcaaggggacccattgaagttcattcacatgctggctagaggtggggctgagcttgaaatgaggtactgggctttggcttcctctgccatagcaggaaactaaaacttaagagctgtgttgtactcacgttggcagcaaacatactaaatctgtcttgctcagagtcacattacagctcactgacaaagcagggacgggtgagcaatgtctacagaatcctagtttgccatgaacttccttcaatccctcccacagctcaggaactgttcaagggccctgatggtttctctcaacctgaaacgtcttgggagcagcagccttccctccctactctgtttttcagtggttggacattaaaagaataaccacaacactggcggcatggaacactgacagtaactacctgactcatggaatcaggggcagaaactgaggcttaagaagcaactgggccaggaatagagaccaggtgaacctacagcactcaaggccctggactgctgagacaacccagcctggggaagaaaaacagagaaccccatgtgtactcagcgtccactgtggtcaaggcaacttcctatagtatttcatcaggtcctcataggcaccctgagatgcagacaccattattgtctccattgtaaggagggaaccaagactcagagtgggaagttcagggcaaatggtacagctgatgcccatctaggccctcctgactccacagctatattctttcctcttcatcatatactactaactctggttgaggaataaggaagacaggagcctggaaatgtgaactcggaggaagcctcacctggggcttggggtaacctgtcctttctagagaggagagaacctaagaactctagagggacctagaacctaacatcttggggtcaacaaatataaactgcattcatgacacaggcttgactttctaaatttctgattggtttcttgagtcaggtgggttgttccattctctctttaggcctcagttgtcttttcctgtcaatgagggacaagtctgttgttatctttaagggtttaatgtgcccttagatggactttggtctgacaaattcttaggaaacacaggacaatgagaagcgagctagggacagagttgaggcaatacagaacccaaaccaagaaaacctaagcatccaggatgtaactcagtaatggggaatttgtcctctgtgaaaggcccaattcccaacactaaaaaaagcatataagtaacaaatccccacaaaacaaaaggaaaagtcatgttcagaaccccaaacttccaggtcttagccattggctagatgccccccaccgcctcctaatcacttagggtaactgaccccatagttatttcagaaggcggctggctctggcttgtttcaacagttggctgcctagggagttcactgcccccgtttatcccctgtgacacggagaggagtttccaggccaaagagatgtggccatggactggaaagcttctcctgagtggggacccttgggagctgggggagaggtcacctcggtacatgccacacacaggcttctccatgagggcgctatagttgctaaagtcctcttcagttatgacaccccctgcatgctgagcctggaggggagaaaatgtccgtccatcactgtgagcatgtgggcatggcccatgatacatgtctcagtcacagacagataaactgtttacaacttcagtcccttccgtagccaccagcatgtcttttagggatcccatcagcccaaggaaaaaggaggcagaggaaataacaagtgtgtcagaattatcaaaactgaatttgacgtttcactgtaaccaattaaatatactccagagttgggggtatagctcagtggtagagtgcttgtttagtatgttcaaggccctaggttgagacttagcatggccccccctctaaacagtaaggctgctacaaaacttcgaactttgaacgatcctgggaggactgaccctattgaacataattgagcattatttcctgacaaatgcacccatcttgtacaaatcaatgttctcattccactctagcagcatgtgcattgtcaatctcttaaaaacaatttaaaattattttatgtgtttaactgttttgtctgcatggttgtctgtgcaccacatgcatgcagtgcccatggaggccagaagagggcatcagattccgcctggaatcggagttacaggtggttgcaagctcctgcggatgttgagaccgcaaacctggatctctagaagagcggccagtgttcttaaccactgagccatttctccggccccacatcaattttaaattagtattaccattatcaatcttttttcactttctagtatgtaaaacttttgacttatctgcccttagtgaactactcactgtatttcttggctaatacatagtcatgtttctggcagattaataaaacacagtgcctggtacagagaatgtactccatgactgagtgacacacctatgttatccccacagtatataacagaggcttagataagtgccccaatacatagtacactcaatccgcctgtgcaccgtgttcttgaacttttctttgacaatgttctcagaatctatgattaccctagactaagcctctttggagttgggggtatcctcctatgtcaagttcctcagacccatagttcccagggaaaaaaatattaccatcagttcttggaaaatcccagacagagcagggaagattttgggcccagggcaactgagactaatactgtgtttccatcaggcctgggaagaaataggccagactcctgtacagctgtcaccagccctgagaagcccagcttccctctcaagacagagcatctctgtcccatgtttttcatatcacatagtaggtgatgctttttgcccttaatgactgaccactggtctcatttctatctccagaggtcaattttgtttatgagaaacacacagccagaaactatgtagcagataaaaggggaaggacagcatccctgccatagggccacagggcatactccactgtcacactcacctcggccaccatctccagtgtgaggttgccaccattgtagaaggcagcagggccagagacgccaagtatatccagtacctcagctagatcaggtcgtcgcagcagggcaccaggcaaaggtgggtggcccgatggcaggaaagtctccaggaagcgttcagacgcgttgggaggtagctgctcagccaaggcatgggctggggggaggttgagaggctgggtgggcaaggccaagactggactcgatggctgagatgtataataggtggggtggatgagggctaagtgactggccctgagagctctggctccccagaagcctgtcatagtggggcagggatacacgtaggctcttcccagaccctctcactggaggctgtctccaggtgagatggaaagaagtctgaggagcaaactggaaaaaagaacccctttgtttggggcccaagtctcaaaggcctccccattaaccttataccttcccccctacctccaggccccactgacctagatcatgggtcacgttgaagccatcttgggccacagctgctcagaaggccaggacttgggaccagggcagcctgagggggccggagagcagggggtggaggaggtcctgggggaaggaggaggggtcctggggggaggggggttcctgggaaggagaaccctggcaagggaaggggatattaggaaggggagttgggaagggaagactccaggagaacaggagaaggccacccaaggagggatgtaggcagaggcccctggtccccaggggagggtctttacctgccatagagctggtgagcttcatgtagccctttcaccattccaggaacccccaccaagagcccaggctgggcgaggcgggcaggcgagggagagaggagaccaggtcactggaaggggggggctgggctgaactccgcagagccccaagccaggaatggctggcacaggggagagacataggccaagtatcccaggagaaggtcaaactttccccagaggggacctctccctcatccctaacttcttatatgcaaatgtagaatggtctttgtctcccacatttgagtgatttaataaattcagcaaaccattttaagaggcaggacacaaacaatctgggtaaaattctgttcatgctgggtaatgggtacccttgtctttttaaatggttaacaaaggacctcagtttagccaatccatcgtcatgccaccgtcagtcatctgagttgtgataactcaggggtgtgtttgatttttgtcatggcactaaacacctactttctcaagttactctgcttcttcctttgctctcaataatagtgaatttgcctctagcatttttttctcccaatgtgacacagcctgggaaagtcatagtcatcaggcttagagagagatagacagagggttttttgtttgtttgttgctgttttgtttgttttcatgtttgtttgtttgtttgtttgttttttagacagtttctctgtgtagccctggctgtccttgaactcactctgcaaaccagactggctttgaactcagatatctgccggcctctgcctcccaagtgctgggaccaaacgcatgccaccaccaccaggctgagataggtgagtttagggcaacaactgagtgacatttcagtattcaaaggtggctttatactttcttccagacaggtaaaactgccagagaagtaagatgttattgcagtgctatctgttattaatcatccaattttcttatccattttattttgatttttaaattatatttaattaattagtgtgtgtgtgtgtgtaggtgcatataccatggtatgtgtgtgaagattctgggacaatttgtaggaataggccctctccttttactttgtgggtcctggagatcaaatttaggttgtcaggcttagtgacaaatgccattaccaactgagccgtctcaattggtccttgttcgttattttagatggggggagggcaagcagcctgtcgttatatagcttaagagcattttgcttgactcattttgccatagtaaatatgcagcaaaccaatgctcaggttagcaaaaggcaatgtagggagtccctcctgccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgtcccccgcccccccccccctgggccctctcctctcaccagggtcctcaccttggtatcccaggacctctgcagggcctcttccctgagagcccctggtgcggactcccggaaatcaatcaggtggctctcatttcgtcggatatcatgtaccagcatcacacccccgctgggaaagacacagaaagtggaaagcaaagagaacatgtcaaccttctgaaagattaaactaccactcccttaatcccctgcggtgaggttgtgggctgtctgccacattgggtcagatgttggagccccctccccagcaggaattcagacactcagccatcctacaaagggtaaaatcaagggagtaggggacccaggacactggagactttaatccctgattaagaaaaatgcagagactgggggaacaagctgttctgtccccaccctggaccagagctggacccctgccagtttcctgcacctgccttcttggtgtcccctcccttttccctcagaactggattatgtaaggataaaccgttcgaagccaaaaggggaatgctgttggtagagtcagaggattggtcctacgaagagaatgatatttgtcagcttgttccttttccctggcatatttacatccgagatgggggtggcacagttaaatatgtgcagccaagtaacaaaataaggacggcagggcagataagtggctgcaacaacagcaaaggagccagcaccctgacccaccatgggaagctctctctctgctcagctccacacgggcttcctgcacccaaatatcctgattgttccggagaggttagcaatctgaatttttatgaaaactattgatgttttaacaacagcaaacattaaaatgagcaaaccaaaccaatctaggtgctgggtctggcttttgagtgtccaatttgtagccttggttttaagaactccaagcctggggtgtattttctgtggacaaagtccacagctttcatcggagtcacagggatttgtgaacctaaagctggaacatcactgctttaatcgatgtcccccccccccttgctctctgtacacctcattttatacatcacaatatttctctcctggtggaaaaccgtgaaaactgaatacgcccccatctcttccatatggtactactattctgaattcatccagggagaaaaagagttgaaactgggtattgaacaagaaaattcgaggagtatggggctaccttaagctcaaaaccaagaaaaacctgcagccaggcccatggaccaggagacaagaagtaggcctgagggacccaggcctccaccgggtccttacccagctccttacccgcccaggccagaactgtgtggagccacgatccccaaacacaaggctgctgccacagctgcatccacggaagagccttgtttactgagcacctccatgcccagtgctgtgcaacgggaggcatccgtcaccacagcaccctgctggaagatctaggaggcaagagaagagtgggctagtagggctgtccaccaccctccagtacctccatttacctacaacctcggccttcatgtcttcttgattctcgcggccatttcctttgggaaccttcctctctcacgtcacctcttcccttcccatttcctagcaggctcccaccacctaaccatccaattcccatcacccccttctcccaagttcccttctgcccacctgctcccctcacctggggatccccgaagtagatctgcatgaccagcgccacggtgacacccgtggcaaaagtgaggcaggcggtgacgatgaccgtgagcccgtcctggcggcaggagcactcggctgctgcagctgagaatgggtccttgcgtgtctcccgtagtggtgacccgtcctggctgcccatctcggatgaggacgaaggcagccgctgtagccgggcggacttcaggaaggagtccgggtctgtgggttgtctgggtgtcagtctggcagcctcctacctggccctgcagtcctcagggcggggcattccatatggcccccctcggcccgcccattacacaaaccccactgccctgcagtgctcagttttcctccactccaacacacctaaccacccgcccctcgcgggaagccaatccccaggtgggaaaagacctcaaaatggccagttgaaaggtgggattcctgcttctggcaaatagccatgagactggtacccggggataagaatatccagaagtgtgagggttttcagcctcccctggaaactttatcctgtcctagtcgtatatcaaagcctccaggacaggaaggcaactaaccaagccaactacttagcttccagccttgctccacgcacccattcatttgatagatacaagcacctactgtgtgtctggccctacactagagcagataattgcagacattttcaagccaagaagaagaaaagaaaacaagtaaacaagttgtgggggagattatataaagcttgtggggctggggagttggctcaaagtaagagcactgcaagagagctcagtggtaagatctctgcaagcgtgaggacccgaattcaacgcctcagctcccacataaaaagcccctgataccattgtggaacagagacaggctgatcctgagccccagctccacagtcaatctacccgaaaaggccagcttccggttcagtgagggactgtctcaaggcggtaaggccaaggcagtaagggataccatccaaggttctactctggcctctgcacatgatcccatgaatcagtgcgtgagtgtgcatgttctccccaccccctttctctctctctctctctctctctctctctctctctctctctctgtgtgtgtgtgtgagatgcttaccagggaaatcagggaagtgctgcctgaggaaatgacttttgaacagagaatgaagggataagagaagctgccactagtagaagagaacaaggagtttgtttgctatagaatgttctaggaagagagagcagcaggttccaaggccctaatgtaggagtgactttgcatttgaaagaaataaccgaggtctggtggctctggtgtggcagcagacagggggagggggggtgccaatcagggtggaggctagtcctgtatactggccctatggacactgagaacttggacctgacctgtggtgagaggccactagagagttgtaagactggtaagtcacctggggtggtatgaatgagaatggcccacaggctcatatgtttgaatgcttagtcatcagggaatggccctatttgaagggattagcaggtgtggccttattggaagggtgtcactgagggtgggttttgaggtttcaatgacccatgacaagcccagaggctctctcttcctgctgcctgcagatccggacgtagcactctcagctacttctccagcaccacatctgcctgtgtgctgccatgcttcctgccaggatggtaatggactaaccctctcaaactgtgagcaagccccgattaaatgctttcttttataagagctgccatgatccaagcagatctctgcaattttgaaggccagtctggtctgcaaaatgagttccaggacagccagagctgttacacagagaaaccctggctcaggggaaaaaaaaaaaaaaaaaaaaaaaaaaaaaaaaaaaaaaaaaaaaaaaagagtgccatggtcatggagtctcttcacagcaatagaacactgactacactgactaagatgccatctgttttgtgttttcaaatgatccctctggctgctgtgtgaagaacagactggagggaataagaaaggaggtaagggaaagttgaaagccacttatggacaagtcacttcaagtcatgagccccaccttcttcattctagtgcagcacatccctaacagatgggccaggcacaggagtccatgcagtgatatatgaagaaagtcatttccttttctacccatgtaaagttctgggtagggtcaagcacacctgaaagtccagcatcgtgagacagagccaggaggtcacagctagctccccaggcaggctagccggaaaggccagctgctggttcagtgctaaactgtcttaagggataaggtagagagcgacagagaaagggctggggtcttactctggcctccacatgcacgtgcagtgatgcaaacacctcctcttatcccatggtcctctccactaggtgccattacccttgaacccataccccaatgtccagaaagttctagacatttttgaacaaggagagaggatgactttaacaccttattgctgtactcacaataagtgctttgtaagtttaaatgtttgagtgatgacattaaaatttgactgtcatatttttcatgtttacttgataaaaacccaaggtctttgacttggtgtttaagaaccttcatgactcacacctctatcttctatttaaataagaaatcaaatacatagataaaataatatgtgcagaattattagaatgcatttatgatgggcactttcaggaaaagacacttacattcttatttactttgtgtgtgtgtgtgtgtgtgtgtgtgtgtgtgtttgtgtgtgtgtgtgtgtatgtgtgtgtgtgtgtgtttgtgagacaggcagccctagctgacttggaactttttaagtagcctaggctggcttccaacttgaggcaatttgcctgtctttgcttcctgagtactgtgagtacaggtgtgagccaccatgtctgacttatattcctaaaaaaaaaaagtttatgattttattgttattgttatggttattgttagtgtgcatgaaagagagagtcacacagagagacagagaattagaggcagacatagacagaggacagagaggagtgtgtataccacagcaggtacgacggtcagagtacaacttttctgggtttacatctctcctttcaccttgctgaggcagagcctctcttcttgttacttctgcttttcacaccctaagctagaaggcaggcaagcttccagacaattctcctgtctcttcctcctatcttacagaaggagttttgggactagatatgcaaaccaccacatctggctcttctgggtttggtggatcaaattcaagtcatcaggcttgcatggcaaatgcctctaaccactgaaccacaccaccagccctattcctttttatttttatctttctgtgtgcatgcacatgtgtaagagtatgtgtgagaatgaacatgcatgcaagtgtgtggggaagccagaggacaatctcagaaacattcacatcaccaatgatgtctcattggtctagagctttccaattaggcaagtctggctgtctatcaaacctagggacccttctgtatctgcctcctagcactgggcttatacatgcatgtcatcatgtctcgctttaaacaaaaaagattttattattacatttattttattacatttaggaggcagtggtagcacatgcctttaagcactcaggagacagaggtacacggatcactgtgagttcaaggccagtctagtctacagagtgagttccaggacagtcagtgctacacaaagaaatcctatcttgaaaaaacaaacaaaaatattttgttacatcttttacttatttatatagtcattgtgaatgcatgtgtgagagtgtaagtgtgcacacatgcccacatgtgtagatcaacttgtaggagttggttatcttcttccaccacatggatcctggtattgaactcgtgatgtcaagcttggcatcaagtccctttacttactgagccttctcattgacaccataccctgattttttatgtgggttctgattgagcaatctcttcagcatttatactcctttaaaatttaagcacatatattttgtaataaaaagtaaaaatttcacagagataagaactgggaggtaggccaggcagtggtagcgcacacctttaatcccagcactttggagacagaggcaggaggatctctgtgagctcgaggccagcctggtctacagagggagttctgggacagccatggctgttatacaaagaagccctgtctcaaaaaatccaagaaagagagggggaatggggaagggagggagggagggagggagaaagagaacaggagggtagcgggtgtagtagtgcacacctttagtcctagcactcaggaagcagaggcaggtgatctgtgagttggaggctaacctggtctatatactgagttccaggacagccagagcttcttaatagaaagaccctgtctccaaaaacaacaaaaggaattggagggtaggactagataactggctctgtagctaagagtttgtgctgtttttgctaagaactggagttcagttcccatcacctatgctaggtgattcataactgcctgtaactccaattccaggggatcagacacctctggcttctgtgggcactgtacccacatacagatacccacacatacacataattaaagataaaaataaaatcatttttttaaaaagaataggccaggcttagtggcacacacctttaaccacagcacttgggaggcagaggcaggtgaatctctgtgagtttgaggccagcctggtttacagagcaagttctaggatagccagggttacacagagaaaccctgtattgaaaaaaaaaaaaaaaaggaatagagaaagggactctttcccccctcactattttattttgttttttttttacaatcagcaaataatttttaatttgattttaactcctttgcttttaaattattttattgtaattttatgttttgtcttcttgtgtatctgtgtaccatatgtgtgcctgatgccctgtttttagcttattttttttttttttttaaaaaaaagcctgtcaggctgaagaggtggcccaatggttaaaagcactgactgctcttccagagggcctgggtttgattcccagcacccacatggagactcacaagagtctgtgactccagttccaggagatccaatgccctcttctggcctcctcaggtacttcatgcatgtggtgcacagataggcagcaaaacacctctgtacataaaataataaaatacttaaaaacaatttatcttcctggggggtctccctgagttaatcatgcttgcatataaaccacaccattatcaccagcagtctgtaaatcagattccataaccaaacagttgttaaatatcttctgtggatacaaagccctcctagccccagagaaatattagaagggcaagaaggggctttgaacttttatttatctatcgtatgaggtgtgtgtgtgtgtgtgtgtgtgtgtgtgtgtgtgtgtgtgttgcatgtgtatctgatgtgtgtgcacatatatacatgttcttgtatgtaacttcaggcacttgagtgtgtgtgtaagttagagaacagtcttggccattgttcctagtcttccatcttgcttaagacagagtctcttgtttgcagccatgtacacaggctagctggcccatgtgtttccaggttcctgctccatctcccatctcactgtagaagcactggaattaccaatgtgccctgtcatgcttagttttttagatgggttctggagatctgaactaaggtccacacacttgggcagcaagggctttacccactgagccaattctgatgatacactactttttggtttttttgggggagggttgcatatatttccttattaaagtatttttatgacttcacaagctaggctccactatgctcactttacagatgaagaaaccaaggctaagtgggaccacctgtctaaggccataactcaaataagtaggagaatggaaattgtatcactggatagtctcctttctattgctctatgtggcacttgcagctattttcaatacccaaaaccaacctaaggacttaggtgagtgtggtggcacacatctgtgatccccacacttggaaagtagaggcagaaagatccaggagatcaaaacttgcttgggatacatcttatcccaaggtcttatctttaaaaatgcaaataagcaaaaatccaaccttctccaaagagataaaatgacttaagatgaagataatatggcttcaccacaactagacctatttaaaattatccaaccagcatatcaagttactcatttattcagtaaaattatatactgaggaaaaatatcaaaaatgggggggggagtttcttgagtacatgctacctgccctgtgtacatgacagggcaataatcccactaataaaagcaagagtgacatactgggaaaagattggtttggggccaagagataaaagtttattagagacaggcactgtggttcaaacttgcaataccagcacacaggaggctgcagcactcagggttgccacagtttagggctagtgtggattacaatagtaactcccaggacagcctcagctacatagtgagttccaatccaacctgagctacagagtaagaactcagactcaaagcaaacaaataaaaccccaagcaaacaaaaccaaaccaaaacaaccaattaaacaaacactaacccagtatgttctaggagaaaggtgagtttaattttgattatcctgaatttgtgaggcacaaggaattgctgtctgaaggtagctggtcaaaatatttaatgttctttctcctccatattaaaaaaaaacaggttataatataacctaggttggacttgaattccctaggtagcctagcctggccctgaactctcttaagggaagatttctgaacttgggagtgacatgactggaagcgcagagtggcgagtgtatttggggtgagtgcatcagagtgaagaagagctagggacttaggggtcacacaggtacaacaggttagtagctggtctagagtggtgatgccagggtggaccttcttaggagggagggacatagaaaaccaggtcacattttgaaagtgagaagagaagagggaaagatttgaaagtggcttccaggcccctactttggacacttactgaaaggcagtgtcacacactgagaatggccctggacaaaaaggaagagtggtgaagacatgccgattttggcatagaatgttggcatgtagaggctgatgcctaggagaaggctaacatggcttccatttggaagaaagggaacgaaggcattccctaaccttgaagaggtcaccatccagttctctgttctctgcgtcctgcttgggaagtctggcacttgattttggagagtgccaggcaacaggctagccaggcacatcaaaggtcttggctaagaagatgggacagtgccactaggtggcactactaggttgagaatatagaaggtcatattagccaacaaactggtctagctggaccaaaagactcttgggacttggaaacaggcctaagtgacacggcatctaaatgcttatattgttgtgatggcaaggcactccaaggcaaggtcctgggaactttggtgtatacccttgtgataaggtataagttcccaggagctcaattaaccagggtctacgctgaatttctaggcaagtgttctgccactgagttaaactcccagcccctctcggttgaattgccttgcacatcaggacacagcctacactgaactcccataaagcatttttgaggtttgggaactccattccctgtgattatttcatcctgaaatctctttcatctattcattcaaaaattatttattgagtacccaatgcttggctgaatgctggcaacaggatgaatttttaaaaaggccatgattcctgcccttagaggcctcttaggtatgcagtaatcacatcacttcccaaataaataaccttaggtttttataaagcaatgcctttaacaaggaatcaggagacagattaaatggtccaatctgttatttagggcatatgggcattcttttttggaagagaaaactaaggaacagtacagggtaggcacacctactttaatataatgagtcaggactgcactactcaatctctgaatagaaaacctgggttgaccagatggctggttccaccaccacatattttcccacattcttccttctaccactaaggctaatcccccaagaaaattagttttgatgagcagctgtgacatttgaggattcaaagtctccataccccatcataggtaaagagtgatccagtcaggttggtaggacctgctagtcagaaccatatgaccaaaaagttagagagaactgccagttgcccagccaggagtaacaatggaagagtcagactggaaagagctgggccagagaagcagcttccttcagtacagaaagggatatcgctcaagtgcaggcaccggaggaagacagagagggaggcagaaagatgctctaatgccaggaagtgacgttgaggcaaagaggtcagagggatgcaggataaaaaacggaggagagtatagcgctgggccacatggataggagaaatagcgctagggaagggatgttaagacttggcccccagctctctcccaagtcctgcttcctccccccccacacccccatctccttcagtttctgcagaggttgagaacacagtaaaatgcggagactgcttcctggggaacaaatcttgccactgaccagaagctcctaccaacccggcaaacatccgtgccagacccacatctctggaaagggtagagtaacccacagaacatcaaaggcactgagtccccaaggactttgagaggtcatgcagaccatccccttgtctcccaatacccggaattctcagatagaagggaatcatattttctttactcatctctggacatgaagagatagattctcagctcttctccggactctctgcttcccataatccctgactgtgatgaagttctccttaagatctagactatatccctcctgctgcagcctctgacttggtttcttctatcctatcctctgtaactaaagagaagcctttcctaggtgatcacagccgttcttaaggctctcccttccagcattccttccttctcaataggttcttccgaatcataatccctcctactgcagtcattgcatcctttcccgtgtcgcatcctacgcctctaaggcaaaaataccctttcccccaccacacagttatcagagctgagggagaagggaagaggtccaagatgaaaggatgaatgaaggagatgggagactgtaagtgtatgatgcccagaacagatgaaggaggaccaggaccccccaaggcgggggagggatggggacagagggcctcaccggtatccgggtctcccaggaaggcgtcctcgtccttgcggcccctcagcggggccgcaggcgctggctcgtcctcgggcagccgcgggaagctggtgatgctcatgtagtccactggcgagtaggcgcctagggcactctcctggctagcctcgttctctgccgccatcctcgccctaacccccagcagcgcagcgcctgccggaagtggcagtggaggggggtgcgagggcggagggcggggtctgagctcctggacagccgggagggggcgcccccaccctcagcagtgtcctggtctgactcgcccccgcctgtttaaagtctactgttagcagcctgcacactggtgcaggagaatggaagcccggagggcagcggaaggttgccagcaagaggacgctactctgggctcatccctggtccttgctccttccagtctgaatcctgctcagatcccatacactcctaggaccagagactgacttctgatcacaaactccactttgactccagaccttttttttttttcctgagccactctcttctcgggcccaaatctctctgtgggcaccaagattctcctcctccgatctcagactacccctcggacccatctgagactacttaccccagacttacaactctgacttcacttcaccccagattcctttaagtctccaaccctacttcatccagactgtttttttcatctgcagacctctcttgagcctcccttcaatctcacatccttttctgcaccctaaaacttctcttttaaaccccagatccttctggaatcgccctgatgtgtcagcaagggagagtaccccttactgaagcccaccccaactttaggatcctcagaagcaaaccctcagattccactccagggaactaattcagtaggccagaacacgatctttggaaccttaatattcgtctgcatttttcagaattcttgatgtggctctggaactaaggtaaaagaagtcatgacgctgtgatagaaacaggagcagggtgggatgggaaggataaacgtgtaagaacaggggcttaagaagtagcgctttgatagaacgcttgcctgtgtgaaggtttgacctccagcatcctgaggaggggggcgggggcgaagaaaggaaatgtaagaatgagaacgcatccctgcacgctaggtgcctgccaagcccatctctggaattgctaccctagctccaagaatgaaggttttaagcccaaactcctgtagttcagcccacaggcagagatacagggctggtgaagccgtggatacacactgtctctcgctttcccaatccctggctccaggctcaatgtgacttgaactgttttagcatttactctggacacaaggagctgcagtgccacacgtatacagcaggaggcagcagtagatagcgaacatttgcgggagaaaggcttaggaaggaaggcgggtcagagctgtgcagtgaaggtgggagtaagggatgatgacggttttcatacctactggcaaaattgcatgtgccttcttccccacggagaggttttcatcttattagtgaggtctgtagggaccatagtttccgtgacctcatacccctaccagtgagttttgttcccactaaatgagatctgtgtcacctgagtgttgtccactcctccagtgtatgcgaatgctcctccgtgggagttgagtcctctcatcggggttagtaaagtctgcatctcatagagggaaatctatttcctagtcagttaatgccatcctgtcctataagcagaggcagagctcttccataggatctgagacctccagaaaattctgtacctcctaatacagttcatgcaacttcagagagtgtgtatctactcagcggagtgtatgtctccttgacgaagtatctgctccctctctgagatctatgtttattctacaaggtctgtatgtgcttagtgggctccaagatcctcacctcaggatcagttaggctctgggtcatatatctgaacatgaggaaattcttttttcagcttacggtgtgctaagcttatggtcagttggacaaagatcggggcagctggtgggtagatgggtccataagccccaagtagggatcaaaaggcaagagagctgcctgcttcagacctcagactcactcttgtagttagatatttaaagatcctttttctatggccagtctgtgaattgttaggtgatccggctccttcttggtgataactgtgggcaggagatagagggtgtcctactaggcttccctctgggttaagaggatgggggggcagggtgaggtaaactccatttgtggcagatggagtatacataggtgaattaaagagtgcaaatgattgctctttatatttttattattttgttttgcacagaccttggtactttacaagatctagcttctgtttgctccttagctttgtgaaatttcattttctcccttccccctttcttccttccttcttccttccgtccttccttctttccttcctccctctctctttttttgtggttttttagatagggtttctctgtgtagcccaggctgtcctggaactcactctgtagaccaggctggcctcgaattcagagatccctcctgcctctgcctcaggcgtgcaccaccatgcacagttcctttcctgaatttaccttttgtgcaaagagaacttgtgctttttggcaaaggtctggaggatcctcgcggtcttcgcttagagtcttgtactttggatcagggtggagattaatgcaggcaaagaaaatggcaacatgcccttagaggtgggaatcagaaggccgcgagttggcaggaaggatcatatcatacccgggagctgtgccctcaaggtcgcggaggaattttttcatgagactggaagaggggtgttgcttggcgggagacttagaggagtgtcaccagaaggaactgtactccacctggctatccaactcggtggagtgacaggattgtgcaatcagaccacggtgtgtgcacagcggatgacccaacgcttctcattagtcagccatttcagtctcgagctgcgcggcgccatcacccaacccccatctgtcactccaagaccctaacttggtcactccacagccctgcctcctctcctgtcacttccaacccggctacaccccatcactccacgacccgcctcctcgcctgtcacttctggccccgcccctgctctgtcattccaaagctccacccctctcctgtcattcttagaccattccttcgactttcactctacggctacaccccttccggcaagtcagctccgcccctaccccgacttcgcctcagcggtttctgatgaccccgccccctcgcccacggccctacccactattgggtgtttaaagcacggcctccagcctcaggctccgccctcgcccgaggccccgcctctagggccgacctgttttccacgccccggcacccgcagcaaccgcaagagccgcacggtgctcagaacttgacgggatggggcttcccgaggagcagcgcaaaagcgacagcgggagccgggctcgggaggagaccggctccgagggccgggtgcggggttggtccccgccgccggaggtcagacgctcggcacacgtctcctcgctgcagcgctaccgcgagctgcaccggcattctgtggaggagccagggggtgaggctgggcccgggagactcttgggggcgccagagagcagaagagcgggactccgaggggcattcaccgcgctcccttagggaggagatggaaaagggattcgaaagagacgacgttccatgagaagaaggaggggtctgtgaagtgaaggttcctagaagttgggggactctctggcgatttggtagttttgtgagatgtgtgctttcacaaggagatgcgggttctgtgaggaaaagcggggttcagtgaacagaagcggggttcggtgtgcgaagaacccttggggagactggaaaagggatttccgcgaagactaagtcgcatatgagagagagagggagagagggagagagagagagagagagagagagagtctctgaggtaaaagaaaagctccaaggagcaagtgtgcgagacttgaggaaaggagaacccagaagagacagaaccttctttgcctccaattcaacaattgcctccctcgctttgctcagcggcagttccaagcctggttcccatcttggggtcctgcatctatttaatatagtagcaatcccaatatacgattgaacaagttgttaatatgtcaagttttttgttttttttttttaaatttggccctaagttgcagtgactcagattctaagagataattctatgcctttaaaaacgtgcccgggcagtttagggggcaaaaccatgtccttgccaggcctggtggcacacacctttaattgcaatcactggggaggaagaggcaggtctttgtaaattcaaggccggccttgtgtgcatgggtagttccagaacaaccagtgctacatggcaagaccctgccaaaaaaagaaacaaccataaaaccccactaccatatcccggttgggaggcagcatatttagtggtaggatacacaagccacgaaccacactcagaaaaatgcataaaaacctttttttatagtcttaggcagatttaaaaacctacctaaaatgtactcatctccaagataggaataatagtactagcttcatagattatgaagactaaagtgggtaataaaggatccattatcaaaggtttgatgcccaagcagtcattaaataagtaacgatttgtttagcaacaacaaatcccaagcagatcccaagcaacgaaaaatagtactgaatcaagtgtgaagttgttccttgctacaagtagtgtccaagtttgattcctcgggtgtcttttccttctctttctgtattttctcccatcaggagttacatctggggtaagtttgtaccatagcaattcatattctatgtatctggcctcctaccttgtatttcacttatatttggtccccaaatttcataggactatagaccatttgtatttcacataccctgaacaaaacaagactgtgagtgaggtttcccagttttctctcccaaacttgctttcttccataattatttttttctttctttctcttttgccccaattttctattttctgctcgtgtcaatggcactaccccaactataaacctcttccatcattgtcttctcagatatctttcctacaccttacaaatttatagatacttattgtttactaagcagtatttcagtttgatttgatctgagtaccacccacattttatagaggaagaaacaggagcttagagactaactcacttaaacaaggtcataaagcaaatcattgacggagttgggctttaaaacaacatgatcttgactagagaacttgtactctgaatattatgctattcttctctaactctgcagtttgcttttcaccaaattctgtcaaatactactttaaaatatctctcagactgacccttcctttcatttccacagacacttaaagtcagaacaacaggaagcagtttcctaatttgtcccctcctccctagtcttaacacctgcagttgctccagcagacttatctaaacaccattaggctgatattcttggaatatgctttcatatgcctttgttaaaaaaaaaatctttctgttttctccgccccccctcctctgtgacaggctcttgttatatattcttggctggcctgcaactcaccatgtggatatggacaaggcttgcctcaaacttgtgatcctccagcttctgccttctgagtgctgcagttatatgcaggtgctaaatgcctaccttttaaaaatgttccccctaaattaagattctgcttttcttcaggagcctttgggtaacctagcttcacctcttcaatcttctctctactattctctattatattcttcattctagatagatctacttcatatcctggatacctaaaagtccctttccttgtttggttttgcccaaccaaacctaaaccccacctgagcctcagttttctcacttataacattaggaatatatgtatgtatatatttcataagcttatgccataaagattatattaagttagttcagtcctaattagtcccatctttcatctttacagctttgtatatttactaaatatcagtttccatttgatttttgaaaaaaatggccattcagtatttttttatattactagttattaccagtttttaattgttgggcttttgagtttgtgtgtgtgtgtgtgtgtgtgtgtgtgtactagaggaaagccttgggagtcacagcaagtcccagaaatccagctgtctctgcccttaaagcactagaatgacaaatgatgacactatgtcagatcctgtgcttgtgaggcaagcactttatgaattgagctatttctccagccctggtcttatgatttatgatttttttaatagtcagggtttcaagtagtccagactggcctcaaatttcctgttagctgaggctggccttgaactcctgattttctacctctgccttccgagtgctaggattacaggcccacattgatgtacccttccttccctagtttcacttttgtagtatttctataaaaacttttttagtaatgctttcttcccttcttttggattattttcttggaatatatttccaaaattgagttagcaaataaaggttctaaaaattttataactcttgccagatatttcttacagtgctgttattgtataaaagtatctgattctctagatagatctcatgtagtgaaagcatagaattaaattaaaattttttcgctagttttataggcatacagtagcaccttgggttgattgcatttttgttttctttataaattgaaaggtagtatatcaattatattgttttgtcccaatatgccaaattatgaattagttcctgctgatggtttctttattttcagtctcaaatagtttctgtaaatgtaaacccttggttttctttcctatcatagtagtcactttcttttggtttgagagtaaaatatattcctatcttttgaaaatcaacaaacatgtcttcttaaggaaattcaaatcttgacttagtaatctatgaaatcttaggcaaattatttaatgtctccaagccttgattttcaaatctatatgataaacaaaataatgcataccttttaggaatgtactaaaggctaaattaaataatacatataaatagctttaagtaacacctgacacacatgagaacttgtgcaagtagttgtaaagaaaatactcaataaataattgctaagagagaatgaacaaactaggagatgattgtggaagactatatgggtaaagaatttatttactgattccctactggttactggtcattgtgctaggtattgtgtgatacttttgagtgtgcgtgcatatgtgcttctctctctctctctctctctctctctctctctctctctgtctctctctgtctctctctctctctctctctctctgtgtgtgtgtgtgtgtgtgtgtgtactagagacaaggtcttaatattgaaggctggctttgaactccctttgtaaaggctggtcttgaactcctgataattctgcttccacctcccaagtgcctggatcattataaatgtgtgccactacactcagatagacagctttgtgtacagaaggaacaatctgaattaagattcaggaacagactgtaggcagaagaataaccggtgattagactagacaaatattgagtcctgggacagggtgattgtaacttggtcccatacatatactagtaatccacctgatgtttgagatacttagtgatatctggccatctctttttgttgcagagttttggggaaacattgccaaggaattttattggaaaaccccatgccctggcccattcctccagtacaactttgatgtgactaaagggaaaatattcactgaatggatgaaaggagcaactacaaacatctgctacaatgtgctggatcgaaatgtccatgagaaaaaacttggcgataaagttgctttttactggtaaaaatatttatagtctgtgacagataaaaatctcgtatttatatgtttcataattcacaatgtgctttatttttacattgaaaaatattgaaattaattaatcaattaattaattgtgtgtgggtgagtgtgaaggtcagaggacaacttcaggagtcagttctgtgggtcctagagactgaactcagatcatcaggcttggggacaaatgccttttacctgcagatctatcttgctacccccacaattcctacatccagattttttgagacagagtcttactgtgaaatcctggttgatctggtatttgctatgtaatgaaaactggttttgaacttgttacaaccctcctgcctcagcctcctaacaggtggaattacagttgtatgccattcacattagactgtaacaaagtactttacattccataaatttacttgatccttgcaccaaccaagatgagtaagcaaagtattgttgatttgatattttattaagcaaaaatacatcaaggaagttaaattaattcttcagattacataacttctggtaacaaagtcaatataaatcaagtgatcctcctcttcttgatttatgggtggagatgaaaataatgggtatatagcagagaacaggactaggttgtttgtttgtttttcattcttgctctggaacaaaaaaatgagtttaggtttttcaccagctctatcattgttatcattaattttattgagttaaaaaggttgagaactatgtttaggagcctaagaaatatcttatttgatgctcacagtaactacaaaagccactatgccttgaaatatttctttcttcctcccttccttcttttcttttccttcctttccttccttccttccttccttccttccttccttcctttcttttctttttcattttggttttttgaaagagtttctctgtgtactctggatgtcctggaactcactatgtagaccactctggcttcaaactcagagatctgcttgcttctgtttcctgaatgaggaatcaaaggtgtgtgccactaccacctagcaacctggcaagctttcttttgaaatatatatgttttattaattctttgagcatttcttaaaatgtatttgatcttattaaattccaactcctcctcctcctaattcatcccagatctaccctcacatgcctaccccctcagacctgtctgggttggatccccaatgtatgttaagactctaagaaacagtgtttagtggaactccaatttgggaagtactgctttaagtaatctaccaggttaattccaatgctaaattctgtggtaagaccttattacttggcttttacatgagcacctgttcaataataatttttaaagatactgagtaccagggagagatggctcagggttaagaaagcatactgctcttgcagaagacccaagttcagttcccagaactcacattgggcagcttaaaccgcctataatttcagcttcagggattctgatgccctcttctggattccacaggcacctgaacacacacatacacacacacacacacacacacacacacacacacacacacacacacaccggaaagagacacatacacaataataaaaaattgtaaaaagatattggatattcagccttgtattaggtgttataaatacaggggtagagaaataggaaaaagtatcaaatggacaattaattttccattctttttatgtttatagtaaagtaaactatgaatggactgcatttgctataataaaataaaatacaaatatactagacatatagctgctttctttgttgaacccatatttgtaaatatactcaaattgctttctcttctttctttttcttttcttactcctcttcctctattgctgctgctgctgctgctttttgtggtactggggattaaacctaggactttcacacatgctaagcaactgttttatcactgtgccacactcccagctcccttttaattgtctttaaagaagagattggcttcctgttatcatagatgagaatttaaatctgaaacacctctaacttctcctttcactaaacattatttttaaattaactttaaatcacattctttataagcgagtgtagtaagtgtgttaaaatggctattccttttcctttttttgttttgttttgttttgttttagagctatggttgcacatatctcaggctagcctcaataacatagttgctgagaatgaccatggaattctgatcctttgcctctacctccgtctactgagtactgggattatagatctatactaccatgcccagtttattctggggacttgtgcatggcaggaaagcattctaccaatgaagctatatcccagcctttgcatctcctttcatgtacaatttttttgttttctctggaatcatcaattacctactatctttttcttgtactatttgcctttatcatatactctgaatttcctagactttcttacatgtattctaagaccttctttctctccccacaagtcttctctgttagggtccacctttatgtttttttattgatgctctaaaaataaagattttagtgatatttttctggtagtgttaggatttgtgctatatataatttttttagcaagagagtctttactatatagcccaggctattgtggaactcactatgtaacccagtttggtctcaaattcatggcaatcctcctgcctcagcccaggtactgagattacaggcatgagtcatcatatctggcaagctttcttttcttattgctttcttctcagcttaaatagtgtcatttagatgaatgcaatattactagcatactacatttacagttcatttcttgtcttgggacatcactgaagaaaaccacaaggaaaatagcactcttaagagcattctctggttagctgaaacaaaaccaccacaaggaagaatttggccttttactttggcttggaacataataaatgtttatagaattatattatttttagaactctatgtgactgttagagtccacataggtcaactttctttatagattagcaaatctaagattagctagagagggaaagtgatttgtatcagggctatttccctgtttgaagataaaatggagactaatcaccagagagctttactcctagtcaactattcttttctttaatatgacactgccttgttcaaggagtctaacgctaggcttggcagataaaaaatagaaattgaccatgttagtcaaattaatttgttttttcaaattgaaatttaaaaaccagataaagtttgttaagtccagtattatggggtttacattctattttgggagaccagataggtatttaaaattgctgtcaccaaaaagcaaacaaaaaaaatcaaacaacagcaggtagaggcagaaagatcaggagctcaaggccatacatggctacatagagagcttgaattcagcctgggctgcatgagaccctatcccccaaaacccagagcaaaaaataaaatatacataaaaatagcttttatatagctgggtgttggtggcacacgcctttaatcccagcactctggaggcagaggcaggcggatctctgtgagtttgaggccagcctggtctacagagcaagtgccaggataggctccaaagctacacagagaaaccctgtctcgaaaaaccaaaaaaaaaaaaaaaaaaaaaacaacaaaaaaaaccaaaaaacaaaaaacaaaaaacaaaaccatagcttttatattatgcagttgtcaactaaataaaattaaataggatcacaaactcatgtgtccaatatcctggcatggtaaaagggcttaatagatattaatcactattactataattttggatagtaaaaacatcaagtctcaccaagtggtcagcactgaaaccatatacatacaagcaacataaaacagacttagcagattgtatttatgtatttgttcacacacataaaataataatcatttttaaaaagagaccatgaatttgagagggagtgaagagggaatatgggaggtgttggaggaaggaatgacataattatactttaatttttaaaaatagcaaaaactaaaaattattttgataagaaacaaaacaaaacccatcatatctttttagaacaaaagttttatgcaaggaacaatttatttattcagcaaatactttttgagaacttattgtataccaggcactgttctgaacaaaacacaaaattcttttttttattcagtataaagagatggacaataaacaaacaaaatgaaacagataggggttgaggagatagctcagttagtaaagggctttccttacaaggccttgagtccaatactcagaacacacacacaaacatgcagacacataaacaaatataacagacagtgataaatgttatataaaaatgcagatcaccaggaaaaggagtgacagtgcagagtgggagtgatgtgggaagatcctttgctagggtaacatcatttgggcagagatttgaaagaaataatgcagtatgccatgcagataattggggcagggaagagagatgttccagatagatggaagagcaagtgtgtgctgatgctttgtgtgcttgaagatgggtaaattagtatagctcgagccctttaagacgggatcagggacaatacggggtttggcaggctgctagatcatttagatccatggaaaccaatgtagattgttactttttgtgcatggtgaaaagggaatgcacgagacagtcttgagcaatgacatgacaataacttgcattatacttaggacctgtattttaaatgaaaataaaaagtagaagctgtgggaccaattacaaggtagaaatacatgtgagccatgatgatttagataatagtggcaagttgtgaaggtggttaaagtgctcaaaatccagacctattttgaatcaagagtccatggcatttgccatcatggaaggttctaaatgatcttgcagtctgctgacctcaacacttctttgatgcagataaagtccaggaatgggagatcactattcttgagatatgccaaaagattcttataaagaagaatgatattgccatagctagatttaagaagattaatctggagttgggcaaagtggcacacacccttacatttgagaggcagaagaaagagcatcaaaagttcaaggccagcctcagctaccctatgagtttgaggcaagcctagctatttgaggacctgaattttgtgaccaattattatattattgtaatataattatacatatgacaccatgcttggcttcttggagatattattttaatgtatttttacatgtactcatttattcagtgtgtatgtgtacatgtatgcatgccacagcatatgtgtggcataaaatattatattgatgatgtaaatcattaacattcctacctactgtactgagacagcaatagtgacagagaggttacaggcaaagtcttattttggagaacacatttaaccctttttaaaatgagtatgtgcctttgaaaaattttagattaaacaagagaattcttggttctttcctcattcttcctctacttctattccattcatacttatctataatagtttccttccattccactcccattagccatctgttctctcctaccatgtaggttctggagatcaaactcaagttgtcaggcttggtggcaagtgttcttatctaaagagccatcttgctggcacaagatggcccttttaaaaagagctaatgcttaatctagccatcctagtttttatttggatttcttttacttacacttgaattacaaacatactcattacaacttcaaaattttacatctagggtttttgaattctaatttctttgaacattttactttaggatcacttttagagtccatagattttccttacttctcaaattctaacactgtcccttaacattaatgagttcaaatcagatttattctttaagttatcatactcaagaaacatagagctctgtaggatatactatatggaaggtaaaaagaaattattagatctttcatacctttgttacctgccttgtagttccttctgacaaacctagaaataatcctgtaaataaattaaaaccacagagttacactgtaaggtgtttccaatatttggctactggaggcccatcagcagagacatcaatgtatcttgcctctttaagtcttagttttcccatttgtggaatggaaataacagtttctatcacaggttgttgtgagaagtcactgggataatttttgtaggagcacagctaggagcccaaagccacattacattgtttctttcccatgttcctgtggaggctgatatatgtgcgtgggaacttgctgagttcatgtgaaacctttgatctattgaagggttcttgttgttttatggaggaggttatactgagtcctcattctctggttcctcacatgatatagttccctaaataacccttttgtcattagctagtcaactccagacatcctggttgtctaagatctctcatattccagttatggtcttcctcacacatcacactgtttccatgctgtgacttttcgtgtctatgatgacatcagctacacaggcagctgtgctttaaccactcagcttctcacagctgtctatactacctaaggttgactgatagattgatttctttctggtatcttttccttataaatagggtctttgttgtgtagtctgacaggaaatcctcctgtatcatccacctaagtgccaagagtgcaggtatgtgccaccactcctagctataaatctgtttactttttataataataaactatatctcccatttgctgcacttatgtattttttcccatatatttaacatgggtatggttcataacatttgacagataaggaatttgtggctcagacagtacaaatgacttggccagggtcttaaagtaattatgcttctactttcacagcctttgcttttttgatatttggccatttgtctagtcagtagtttattaagagggtataaggctgttttgggaaatgtcaactactgtttataaagctaaagatattaaagtgaaagcttaataaagtaatatcttttccttaactgagatatgctcactcattaaataattttccactgaatatatacatcataacttgagaacaagcttagggcaatacataggggatcatcagagaggcacttttgtagttcaggaaagagttgacaatagtgataatggtagaagtcagagaaatggtcagattttatatattatgaaggcaaactcaatagactttgcagatgggcttgttatatgatctaaaaaagtatctccaaggagggccagcaatatgactggtagtggtgcttgctactaagtctgataacctgagtttgacccccagaacctataacttgtcttctgacttgcacaatataccgtggcatgcatacacatacacattgaataaacattaaaaaagagtatctccaaggagccaagcatggtgtcatatgtataataccagcactcagtaggcttaaacaggagtatgaggctaggctacatagagcaactatgtttcaataaaaataaacaaaaaaagatacaagtttttccctaccttttttatcaactggaaaaatagaatttccattattctagatggataagatacttgagagagaagttctggggaaaagaccagaactttttgtttcatgcaaaaacacaaagttgtagttgtgacaagtgctagcaagtcattgaagagttcaagtatggatatgacatgccagatttatattttgaaaaaaaattcttttggtcattagtgcatttaaaaagataagaatcccaacctgatgacttataggtagaggcctaagctgctttgggattttaaacaaataatgaaatccttcctgaggtttagttttctcacctttcaaaagggatagcaaatcttgtctgtcttaaaagattatgaaggagccaagtctggtggcacagactagcagtctaactacttaagagacttaggcagtagaattgagagttcaaggcctgcttgtgctgtgtaattaagtttcagtccaatgtgggtgatttaatgagatacagtctcaaaacaaaaaaaaaataagtaagaaggttagggctacagctcagtggtaatgtggttttacgtggaccctaggttcagtctccagtaccatcaaccaaaccaaaccaaaccaaaagaactgccacaaggattagctgaagtttaaaatgaataaatatactacaacaattagaaaattatcaaatttatagaaaagttgcaaatacaatacaaataacctttccctgaacaatttgagggtaagataaacaagaacttttccctctataactctaatatgactctcaaaacaaggaaaacaatattcatatatcccttgccatctaacccttggactccattgctgctttgttgaaattgttccagtagggatactatttcagcccagatacatagaggagggcctaggctgtcccccaaatgacgacagattttgatgattcccccacagaaggcctcaccatccttggggagtaggtggtggggggtgggttgtaggggattggtaaggggcatgggaggatgggagggagagggaatgggggtattgatatgtaaagtgattgtttctaaagaaaaaaaagaaacaagtttaagctaaggcttagctttcttaattaataataataataaagaaattgttccagtaatgtcctttattgcaagagggctgagctaaataaaattaacatataacacataatattaatatattatatatggctgctgtgtctttttagtctccttcagtctagactagtcctttagtcttgactctcatgcttttaaaaggctttcttctcagtcttaacagccaacaaaatgtaacctagatactaagctaaattggttgctatttattttataccagtgtatattaagttagaaaatcttaaatctgatatctagatttagtgaacacacacacacacacacacacacacacacacacatatatatatatatatatatatatatatatcttctcttctagcctctagcagcaggttttaaattttttgatatttataggtaagtttcagatactacagttaagtatttaggtaataaacaagagaaatctggtctttgtcctcatggagctcacatgattgtcagctgcaatcttctttaggaatgaattgttaggatcgatgtgaaataaggaaacaaagaaatgtaaaaaaggaaattatttcaagggagaatgtggagttgtggagggcatgtctctaggagcaagtggctatacatgtgttcccatgactcttgacaatgccaaggactatttcacttttatatttgtttacttatttgtttggtgtgtgtgtgtgtgtgtgtgtgtgtgtgtgtgtgtgtaggccaaaagacaatttgtcaaaggcatgtctttattttccaccatgtgggttctgagaattgaactcaggttggtaggcttggcagcaagcaacctttcccattgagtcatctcaccatccaccaaggactattaaagttgacatatgagatcttccttgtttgattgaggttgtgggtctttcaggaaattgtcaagtggtcgaaaagatgatggtaactgtggtcttggccacagtttgaagttcaaagtagatgggagtgtcctgtacttcccacggtgcttctagagttttcaggagagtgatttttccatgttcctttggtgcagtagagtaaatagtctggaattcaaaacctgaccctagttacaggtttacatttaatcccctgtgtgaccttggcaagcctcttcctctggacttgtaattttcaaatgagaatagtaatcgttgttctacccactgctagggtagttgtgcggatcaggttaagggtgacctttagagtggttatatactatagtcatgtgaggaataaactgcacctgtattgatttactcaacatgtgagcaggtatggcattacttttctttgatatttatatcagctaagttttccctctaccccatgtaagcaagtattcaatttctgtataagttttatactctgaatctttcatgaatgagtacactgatccactgtagaaactcaggtacatttgctgacatatttttgttgaaactgatttagagaattgctcccctacctctgggaaggagagagaatcaacaaatgtaagatagactagagaatattctgtctaacaccagcctttcccctcttccaactctcttttcccatcttatattttacagaggaaaaaataatctgagtttgtgtaaatccatatattgaattagggataaatagtaaatatagatctagaaactccatattcagaactaggggatcctgtatttttgcatgcaaaagtaagcacttgaaaatgttgttagaagtctaggaccccaccccagcctttctgtttgttttttattttatatgtatgggtgttttgcctgcatgtatctatgtgaacctcatgtgtgtagtagctgtggaggtcagaagagggttcagataccctggaactagacttatagatggttgtgagctgccatgtaaatgctgggaatagaacctgggtcctcaggaagagcagagagtgctctaactgctaggccatctctccagccctgccagcctatttaaccagaatctccagaaataaaacctctgaatctattttataagcttctcaaatagttgctatataggaatagagtaccccagaaaattctttcagcactggggttatatcagttgaaagcacatacctaggatatgtgagggttcaactacctccataataatgtttaagataggaaactgacattttttaaaacataagagaaagggtaattgtgaaagagtgggaaaagaaaatcctctccagatttcctaatagatcagtgttaggaaaagattacatacagaaattgaagaactggatttttagtcttttaaaatttcttggttgggcattggtggtgcaccaaggaggcagaagtaggcaaatctctgtgagtttgaattccttcaaccatacagttatctgggctttaacacattgattttcttccttaccctttccccctggatttttgaaaaaggccatgatatttaggaggaaaatgtcttgaatagacatttagaatatcaagtttcagggtccaaggtgatgattactaaccacatgtcattttatatttaaagtaagattaagagaaagcaaactttatttttcactcacattttaagtgtttactagttacatatgggtactggctactatgttggacagcaccactttagaataaagtaatatgctagggaaccccaaggccatcacttactatttctgtgccttagagcaagtaagaatggtagatctcaaaagctctattcttctttaaccttcatggtgatttgtgattcaattttggaggtatgccccccctccacctttctttcagctttctgctacagcaagagcagaagtacccaaggggaacattagttgctagtttgtcaaattatgttgtttccacttcctactcccttggtggaaggagaaaattacctgagggtatgcttacatcagagttccatttgtgcaacactttatgggtcatagaactctttcatattatttcttcatttttatagtttcaaagttttctgtttctgttttgtttttctgagacagggtttctctgtataacagccctggttgtcctggaactcactttgtagaccagactggcctcaaactcagagagtggcctgcctctgtactgggattaaaggtgtacaccaccacacctggatcaaagtattcttattctgccaggtatgtaatgttatgtctgtatcccataattccagaggttgaggccatcttgggttagtgagatttggtttcaaaagaccgaagtttggagatataactcagttctagagcatttgcctaacatgtatgtacaaggtcctgagtttgatcaccaatactaccaaaataaaataaaaaagaaattcgaggtccataattttaataatattcatgaatataaattatatgggggaaatttgtcaaatgagaagtccaagattggtgtggtggcacacatctgtaatcccagcattcattggaggattaccagaagtttgaggccagctgagctacatagcaagattctgactcaaataccaaaactctaacaaaaaccaccaatgccacattctctggaggatcatctagtacaaataagtactagagttttcctggacaaactgaatgatcctattcttcaactctatagtatatgacagaggatgtcttagtatctgcattattagcattatttgaacatactttaagaaagactggttttgcttggttctcatggcagaatttgatttttagtgtctctgcaaatctcagattctacttgttacctccagagttagagttcccaaaggagcacatcctatctttgaatacctctgccagttagaaagactttctgtatacccagctctctaaagacacctaactactccacttatagttacataatgctaacatgcttcatacccataataatcattcagaagtattagttcagaaaaatttattaagtacttactgtaaacaaggttctgtgaaaaacattggggagtcagcaatgaacaagaacaccttggcctctgctttcagggaaacagctaattttctttcatcgatttgctgttagttttggtgtgtgtgtttctatggtgtgtacatatgtaaatgttcataagtgtgcaggtgcataagggggcaggaagttgactttgggtgtctgtctctgttgctatctgtttgagacaaggtcactcaacctggagctcaccaattcagtaagactagctggtctacaggccacagagatcttcatttctttaattcaccagtactggcatttcaggcacatgctgccgtacccagacatttagcgggggctggggatcccatctcagatcctcacccttgtgcaataagcactctactgactgaaccagctccctagcccccaaacagccaattttaaaagtaaatcacataagaatagcttgagaaaataaaaagaaaataagcagaatgtggtgatgaaaaacaagaaggggtggtgctatttagaattagagaaaatctcactaggtagttgacatttaaactgagatttgaagcataagatagaacaattcaaagaactaaggaaagatagtaaatgaacatggggtgttctgtttataagaaagggagtatgtttggaaccttagaaagcataataggagaatggtacaagatgaagtagaggaagatataagggacagaagtttggtttttcttccttatgcaatggaatccattggtgagttttaggcaagaggctatgtgcaggaagctatgtggtctgatttatgtttttaattgagcattctggatgatgtgtatataaaaggggccactatggtcatccaagcaataaatgaaaattgcctgtaactaggtgaaagcaacagagatagagttatctgaaaatggctaaagcacctctcaatagcttctttttccccagataaacatctggttaatgctcctctaataacaggtttgacttcttattgcagtgtttgtttttgcacagcctggcccactagagtagaacttcccccaaaaaggttctatgaataaaccagttttcccatttgtcttttattgggaggcagggtattggaggatcttcatgcatgtcgggcaagtacccagtcctaccaaccatctttcttccagtcctttggcccaaatattctttacttgtagttgtaaggaattaaaaatctccaaactgatgactctcttctcatagaaagagagggtctctagccttctctgttgttaatcacctaacagtctgatgacttgactatgacattgagtaccctattcagctggccttagctggaaaaggcaaagaaagaacatgacccttgtcctctgggtgtaatagaaaaaataagacccatgtaaatgcagtacaaggttgtgtgtgttcaggtatcacaggaaaatgaagtgaaaagggactggaaaggtgaaagaattttcagttttgggggtaggtggggacaatttcatggaggatgttcattttgaaggataggggtgttcttccaagggatagacaagtatagcctcactgaaaaggcagcccttcctgtaattccagcatttgggaagctgaggcaggaggaatgctatgtgtttgaggccattccaggctacatagtggttccaccccagcttgagtgatgcccagcctcaaaataaataaaacaagccaacatttgagcagtgattcaaagataaagagcaagccatgtggtcatctgggggaatagtgctacaagtagagggcaaggaatctggggtcaagtgtgtttgtcaagcactaaggcagccacgtgtatgaagcagagggaacaggaaaggaaagcagaacaagaacatgtgagaatagaaagaattaagaattagtaagaattaatagactattggtaggacttgggcttggactcaaaactgtataagaaccaaccttagtgttttgagcaaaagaataacactctgacttattctgtaaatggaataataaaagcccagagtcatatatatagaggaaaatgctgaaagatcagagagaaggggcaagccaaagccacctttaccttattagcttcccagtgaaaaagagagtgagttcctgtttcttcctgcttatatcctctttctgttcagccatttcacttcctgtctctgcccagccatctcacttcctgtctgtctgtacagaccttcagacctctatgtttagctagtggaaagctccgtcctctggtcttcagacaagttttatttgtacaagcaagattccaccacattacccattgatgattttgacaaggacaatagaagtaattgtgaaaacacacatatgtacatatatttaaaattttagtatttatgtgtttgtatgtgtagctgtgcatgtgcccaaagaggtcagagaggtgctggcttcctaaagctgaaggttcaggcagttgtgagccacttgatgtgggtgttgagaatcaaactccgttcctttgcaagaacaatatatactcttagccactgagtcatttctctagcccctaagtatattttcaactaccagtggactagagtaaagttggagggtatacagaagggctactttgaaaagactctctgtagaagattccccaaaagaggaacatgagaagggttagtgatggtatatcctttgttatctcactaaccacatggcttccaagtgaagggcaagtaggcttatggcagaagttctcaatcagtaatctatcagttaaatctctcattaatagttctgtttggtttatggtgttttttttcttgagacagggtttctctgtagctttggagcctatcctggaactagctcttgtagaccaggctggtctcgaactcacagagatccacctgcctctgcctcccgagtgctgggattaaagatgtgcaccaccaatgcccggtggtttatggtgttttaaacctttgaaaattagttatccgtatttgaaaatttgacagaaatatgttccagacctttaaaaatggcaacattgagccactgaacgaaatttaacaggagctaagttgggcactggatcctttagccaaagcatgtgttgtgttttctagttgattcctctattgttgcccctaaactgaggctgaatatagttctacatatattattactctcatatagaaaaattaagaggaaggaaaataatttcctgtctctgtcaaattttagttatgtgatctacttcactcatttacctggacacggttaatatggttaattttttcacattgtgctgagaattgagcccaggaccttgcacatgcttgaaaaatactctgtcactgagctcaagcccagtccctgttaatttttgatcttgcaattccccttgtggaagaaagaagactggactctgagtccttgtacctgttcttctgtaaacaattattttttccaaccatataactaacagtctccttgaatctcagagttaggccaaattaattgttctgttaaaagttcaaggatcctagtgggctttggatcttgaaaaggtcaatttttgttcccttcccccttctagccagccagggtcccaagcctggtgtctgtgacagagaaagaagacactggaatgagtaatgtacctatgtcaataatttatagcttacgcacatagccaaagagaggaacacacactgtgtgtgtgtgtgagagagagagaggggggttcaagtaagctgtgcatatatgagctttgtacatctgttctcattcatcaaccatacatcaaactttattttcagtgctagagatatagcagtgagcaagacaggttaggtctctgatataatgtagctcatattcctataaaggacatgaataataataagcaggtaaaataaatgaaattatttcaaataatggaaagttttgtgaaaaaataaaagcagaatgatttgatgaaaagtttctaaaaaggcaagctgtacatgtaggtgggtttgtaaatgtactctcaggcagacttatgtttgaattctgggcacatatatttatgcttatttgtgtttgtgtatgtagctcagcagcttttgtgagtataatgtttctatattagtatatatggtcttattcaagagtatttacagaggtgagttggtatggggtacacattgggggtacatgcatgaggacatacatgtcagcatcagctgtagctggagatgttttgaagtttctgtagcatttgacagtgggcagcttttctgcttctggcattcagggacatttgccagcttcccctctccttgttctgtcccattttagtaagcttgctatgcttggcttctctcagccaaggagaagatagtaactgactcatcaagccagaagctggaaagaagcagatcatttctgtgtaacttcgctcagtaagaagaggcctggcatccttgccaatccagtcccttatgctgtgaggaaatagtcctgacttgaaatcagaagatctgaggatctattcttggctctgtcacttattattgtgtgaccttggctggctacttctctctaagtttcagtttcctccttcataagtattctggatagaaaagaaggggagggagcacagacagctcgctggggtatattatatagtattgcatctggaaaaggagggcagaagcaatgaatggcatggtaaaaagtgtggaagagtctgggcagatggcaccaccaagcctgatgacctggaacccacatggcggaagtgtgaacccaactcctcctggttgtcctcaaacctccacacatatgccatagtatgcactcttccaaacaaagaatataaaatggacttttaaatgtggagataggcatgaaccttgtgtataaggaagccagaaagatgaataaaatttaaatttaccacccttacaagggtctacttgatttaactgatgcctacctcttgttttcatctagtctcttgcttgctgtattccaaccacattgagttcctttttgctctttgaataggcctcaattcctttccgtctgatgctttctctgcccagaatattcttccaagaactgatatggtcacctatttcttattgaggttttagctgaaaaagaacttccccaggcctttcctgacactctcaccttaagtggttatctcctaataattatcaatatgtaaaatacacatatctttggccctaaatttgtatttttattaattcatactatggatatatttgcaaatagcatatgaataaggatgatcattgaattattacttgttaaattaattattatatacaaataatagatattatatacaaatagtagataaagagaatggaaccatttttgatagagaatggtaccaaggcatatatttaatttttttttttggttttttgagacagggtttctctgtttttttttgaaggctgtcctggaactagctctgtagattaggctggcctcgaactcacagagatccgcctgcctctgcctcccaagtgctgggattaaaggtgtacaccaccaacgccggacctatgtttaaattttttaaaaagcaagctgattgagttatacatgtaacatttgtccagtttattgcttgtatatagtacctaaggctaaaactgtaccttagtggcagaacacttgcctggcatgcctgaggctctggtttacatccctattatcacacaactacacaactgcttgggtatggtggtatatgcctatagaatgagccctcgggaagttcagacaggattgtgatcttgaggtgacttgggtcacatagctatacttggtctcataaagaagcaataattaaaatgccatcatttgtgtataaaattagaatatgtaagaatacatgcacatagacaactttgtctaacaagtgtattccctgagtacagcaccttttcctaaatcttactgtcccatgctgggctagactgaaatgagcttatccttttaaaaaatgtctaatattttaagttcagtttttaatttctgcctctattggtatctgaaggatttttttttaattatgaagtgtttggccatggctcaggcttcttaatggctagctctttctctttttttaattttattttattagttcaaattaagaacaagcttgcttcagatgtcaatcccctctccctctcttcccctcccccccaacatcccacctgcctttagccatcccccctccactccctaggcagggtaaggccctcaaaatgaaggatttattaattatgcagaaagtatagacttctttccaagtcattattttggtcatcacaaaagccctccatattactaagagtggccttgtctgcaaattgtttctagaaagccactcaaaatatcagtagcagtggttgtcagcaggcagggtgattggcagatatgattaagaggtacacttatcaatacaatctttttatgcagcatcgcctatattacttattaaaactcatgaaacagcagtagaagggagtaagaaaaacatccttatatgtaaattttcatatgcaatcacagtaattcctttgcatatgtttattattgttgaaacaggatctcactcttttaacccaggctggtctggaactcactgtgtggtctaggctgacctcaaacttttggtaatcctcttacctcaaccttctgagttctaggattacaggaatatgccaccacacccagctataattgcatatttttaaaaggtatttttcccagtcactcagttttatatcgctgtattttatttattcatagtgcttataacttacaattattttggtttaattgttgcttatatattacctacaatatcattagtatacaagctctgtgatgttgggtatcttgtacatcagcgtcttgttctacacaagcatattgcatatggtagctgttgaataagcaaagaaagaataactaaaagaaaccaggccaaactggtcaagagatagaaattatgctataggaagtgggtgatattttcattgttgttgttattgagttgaaaatatgtactcgcctttaatcctagcacttgagaggcagaggcaggtggatctatgcgagttcaatgccagcctggtctaaggctacataatgagaccctgtctcaaaaagaaaggaaaattattttattcataactttatttatttactcataggtaaggtctcatttagcccaggctgtcctgaaacccaccatataggcaaggatgatgatgatcttggacttttgatgcttatgcctctacctcttgaatactagaattataagcatatgccaccatgcctattttatacagtgctagagactgaacccatggcttgatgcgtattaggcaagcatgttaccaactgataatacttcctaggccccccaaatgttttatttttaaagatgttacctctggaattaaaaataagtatattcattttagaaagtgttttatttttatagaaaaggtaatttaaaaacctttggctaggctgggcgttggtggtgcatgcctttaatcccagcactcgggaggcagaggcagggggatctctgtgagttcgagaccagcctgggctacaagagctagttccaggacagccttcaaagtcacagagaaaccctgtctctgggaaaaaaaaaaaaacaaaaaacaaaacaaaaaaacactttggctaaagtgtttttagcaagatggcttatcatctaaaagtgcctgtcactaagcttgataacctgagcttgatcccagaacccacatggggtagagagagatctctgattaacactttttgttcattcatcagaaaataaaggtttataaaaatcaatcatgttctgtgaaataaaaatgattgaaaatatttcattttaggattgtcctgtccaagaaaaagaaagattgaaacaaaaaaccagcatgtgagtcaggtgtggaggtttatacctgtattaccattactttggagtcagaggcagggagaattggacgattgaagccagcctggtctgcttagtgagaccctgcaccaaaagacaaatgaagggaagagggagggaggggaggaggaaaaaggaaagagtcagtgagatagataagtggctaaaagagttagcagtgctagcctgaagacccaggttcagtccctggtctcataaaaagccagatgtagtggacattggcaatcccagaactccttcagtgagataggaggcagagacaggagaattacctggaagctcctgaaccagctagcctagagtacaaggcacagcagaaacagtagatcctgattcaacaagatgaaaggcaagaaccaactttgacctctacgtgggcaccatggcatgtgcacctacccacacacaagtaaatatgtaaggatttttaaaaagaaaagaaaaaacagtgatgaaaaacaggacaaaagctctttctgccttcttggtgcatgttgaagcctgctggaaacaggatttcttcttcctttttcttcttcttcctccgcagcctctttctcctcctttttgtcgggaggaggggggtgctggggggaatcaagacaggatttctctgtacaacagccttagctgtcctggaacttgctctgtagaccaggctctttgaactcagagatccatctgcctctgcctgccgagtgttgggattgaaggcatacaccaccactgcccatattatggaaacaggacttctaaaaagcagatatgtctggaaggctattgggcaaggccatttttgctagctataatcaaggtctctagaaccaaagagtgcacatggctcttcttaaaatcaaagatatttatgcttgagaagaaactgaattctatctaggtataaagaaaaacacaatagcatgactcctggagataaactgaataaaaccagagtaatctgtagaaatgtaactctggcccatggaaacaatggcatggtttgtgccaaattctaaagcaactgtcctataaaggccactggacacagaatctatgtgatgctgtacccctcacagatataaatatttaaaaatgggtttgtgcttttgtttttaaaaaaggagcaaaataatcaaactgtattcataaggacttacaggtaacccaagattagtcttgaatttaacatcgtgcctcatctgctgagtattgggacaagaggtatgtgccaccatacctggtttcatttgttgtcttttttaaaaatgactatctttgttccccactgtcccaggccctcatcccatatttccagatgcttggatagtcgagggactctcatatgccaggccagtgttgtaccactaagccatatcctcaagtccaaagatagtgatttttaaattttaaacttatgtcataattacctaatgtttctctgtatcagctgtaataaagaagcagatttatagtgctatgcttcagtgggtaacttcatatccatgctcatgcagatgaccctagttaaactcagtgggtcacaaaacaaaataaaatgacatgcaagtgggaagggaattgataaggaagtaagatgctgttagtatggggaggagtgagtgtggtcagaatatatttgtacctgtaccaaattgtcaaagaacatgtgtgtgtgtgtgtgtgtgtgtgtgtgtgtgtgtgtgtgtgtgtgtgtgtgtgtgtgtgtgtgtgtgtgtgtgtgtgtgtttaaagcagcgtctaaggctggtgacatggctcagtggttaagagcaatagctgctcttccacagaaccagggttcaactcttagcactcacatggcagctcaaagtcttctataacccatttccaatgccctcttctgaccactgaggccaccaggcactcacataatttacatgcatagatgcaggcaaaacattcacacacatacatttcttaaagctggcaaaatgtctcaataggtgaaggtgctttcttccaggccagatctactgagttcaaccccctctacccacatggtgaaaggagagactcattattacaagttgtcctctgacctccacatatgtgccatggtgtgtgtgtgtgtgtgtgtgtgtgtgtgtgtgtacatgcacaagcaaataagttattcttagattttgcattctgatgcaacagagctgagttgaagtccagaaatctatattcaaacaaattccttaggtaactggggcacgagcaatgtgaagcccctattctaaataacaatataatttctttcccctgttcatttttttcttacagtatcccaatctggcatcaagtttgtgatcctgctttatcctacgtagtgctgggattacaggcatgcatcaccatacccaaatgcatgtttcttcatgtattttttgagaaaggtctcatgtagcctagactatcctccaacattctaagtaaccagagatgactttgaatccttgatccttctgcctttgcctcccacgtgctaagattgcagatgactggattttttaaaatggtttttgttgctgtttgcttttgtttttgttttagataaagactcactatagccatggctggcctggaacttactatgaaacccaggttggccctgaacttgacacagttcaacttgagaacttcttaccttcatctcctgggtagtgatattacaggagtgggtcactacattaggctttaattcagtcttacactttataaaagtaatgctggatctggtgacacaaaacctttaatcccagtattctggattcagagacaggcagtgagttctaggctaccttgatctacatagtgagttccaggcatgagaccccgtctcaacaattgaaacaactactatagggcacctttgttgcgtcatttctccttaatacaaccctaagataaaagagaagggcttatcactctattttgtcaacataaaaaataagaatcagaggtagacagtacactttccaatctcataaaacatgcatacaagtactttgagaagccaaagtatctgtctagtcagctaaagatgtggtatcaggggactggagtgatggctcagcagttaggtgcactggctacttttctagaggatctgggttcgattccttatctacatggtggctcatagctatctgtaactccagttttaggagattcaataccttcttctggcctcttgtgcaataggcttgcaagtgatacacagacatacattaagggaaaatacacatataaaaatttaaattagttaattaaaacatttttagaaagatgtagcatgagattcactgacaggagagtgtcaacattgatatgaacagatggaattttgtgactgctcctatctcgtttatgagagaacagagctatgtccctaattactgattctttctgatgtatctcagggagggcaatgaaccaggggagaccaccaagatcacatatcgtgaacttctggtccaagtgtgtcagttcagcaatgttctccgtaaacagggtgagtatcagtgtggaagaggaactcggggacctaaccctgagctctctgaggaactgaaaaaaaagaggacaagaaatggaaggaacctggtgacaggaacagaaaagttagctggacgggggccatctgagtgggagggagcaagggatagcaagaaaggtccatcatagttcctgttctgtgtctttttttcctataggcattcagaagggtgaccgagtggccatctacatgcctatgatcttggaacttgtggtggctatgctggcatgtgctcgccttggagctttgcactccattgtggtaggaacttgggctggtgacaggaaccaagggtgagggatagggttttgagaaggaaattggacctggatcatgaagtatcataaatataggtccaaatcagatgttcagtatcttctggaaccctgttttggagatgctgaatttcatgagcacctcccttcttttatcactcaatcactagccctcgccttcccttcaggtttttttttttcttcttcttcttcttccctagttcgcaggtttctctgcagagtctctctgtgaaaggatcttggattccagttgcagccttctcatcaccacaggtgactaattctttcacctttctccagatcctcctacacctcaagtttggtctctagtctgcttgttgatttggggcaacttggggcagagggtaggggctgcatgcctgccttctcctcatcctacttcagctgactctgtcagcccaaatcatctggaagaaccagagtcaagaagctgattcaggaagggccctgtggacattaggcccactgggagcatggtgtgtactaaggcctggaatgtttattgctccccaaagatgccttctacaggggggaaaaacttgtgaacctgaaggagctggctgatgagtccttggagaagtgccgagagaagtaagtgtgctgacctaatggctactaacttgggttgacaggatctttctccactgccagcttccctttgtccttgctatatactcctagaggggcatgggtacatcttgtcaacttcttttagccaaccagaccagtacttcagccttttcttttctctaggggtttcccagtaagatgctgcattgtggtcaaacatgtggggcgggcagagctgggcatgaatgactctcccagccagtctcccccagttaagaggcagtgtccagatgtccaggtgagtctgacactactatgctctcttttgggctctaactccctctctcttcctacccaaagatttcctattttttctccttggcttcttcatcgtaatactgagatctgggaacaattccaggaaagcttcctttaatagagctggctggaaagcaagaggttttgaccttgaatataagtagagaaggaacttagcatgagaaactgtgaaggttaataggcagaggggacccttagagttcaggcttgggtttgggttggaaatgtactgacttgggtgactatacatactcattttgattagagtgagacttgaatgagcgacatttgtggctttggatccaatacttctgctgaaagcagtaggaaagtgccattaacagcctatagtttggcggggcataggtatataaattctggggtccaaaacaatagaggattacttagattctttgatttgaagtatcctgagtagtgttgggactagagaggataatatgggactagggaggttgggaggccaaacaatattagaaattctgtacataatagggtgaggaaaatagaggctgagggcactagtgagagggcaggctgggaagaaagaagacatctaggggttgagggaacactcacccttccctctctctcctctatctttggaccctgctcatcagcctttccattccatgggctcttaacagggtaagctgaaagagaaatccaagtgcatccgaccccaggtatccacttcttcactgcccttgatcactgcttccctgtgtgcttgtctgtatgttcatctgctctctgtctgtttgttccagtgaggttgctgacagagctaagtctgttccctttgttcctgggctccgacatccatattactcagaagggttacaaaatcaaatgtctgtttctgcctctgtccactcatatataacaaggatatcaaagtttgcaatgacatcccagttcactcctgctgcatagatcctttgtgtgagaggaaactgggaaacctgtcagaaagcatatgctgctcatttagctggcgagtagagccaggaaagacaggaagcatatggaggaggcacgaactctgatcttgtgattttaccatcaagttaggaagttagacctatattgtaaaagaaaaaaatgttttatatgggacaacagagaagaaattcctaaatatatctttatgcaacttggaatttataaaccagacataactgacataattaagtactaaattcaacaaaagtcacactgtaggtggtactcaatgctggttagtatggagcaggggcttggagtccgaggccaatatttagttgcatgacttcaaataaaccatgtctcctctctatacttcacttttaaaaattcaacaataaagacatgatatatgattaaacaaaaatggtttccatccctaaagcaaaatataaaggtcactgttcctatgggcttcagtatcttcacaggttactttgaatcttcatggctgacctcttgtgctagtagtacatataagtcctcactctcatgagtatgtggacacagacctgatttctgggaaactgttttacttataaaatttagtcagcaccgggtatgggaatgcacaccttttatccctacactgggaggtagagtcaaagatccctgggagttcaagactagcctgatctacacagtgatttccaggccagccagggctgtatagtgagaccctgccccccacccaaaaaaaggaaggaaacaaaaactaaattaaacttcttttgaaagacaacaaacttggtggtttggaatgtaggctctggagccagactacttgggttcaaatcctatctatcccatctgcttaggtaacttagctttcttgcttcagtttctgtctatatgaggtaacgatagtaactgcacttagagtattttatctatatatatggcatttggcatgtattaactactcaaaatatattaggtgttgtcattgcctttaaaacatcagacagactagcaatttccagaaggaagactgggaagaataaataaataagtaaataaataaataaataaataatgaatgaatgaatgaatgaaatagcatttcttgtaattcagcctcaagcagcaaactcctgggtttttgttttttggagatgaaagtaaagtgaagtacaaaaaaaaaaataaaaataaaaaaaataaaaccaaaaacaagcaagccagaagcaaacacagaaaattaaattagtctcacaaagctcaggtttgtttgtgtgaaaactctagtaaaagctgtagaagccatggcaggcctccagacccctgccttactatgcagttttcaaagcagggcctggtgctgttcgcaggtgtccttctcaaccacaccacttaacatactccatattcccttaaatacccagtaatcactaaggctgttctggcccaaggacaagggccaactcctcagtttttattttagaagacacaatccttttcttctttcaaggccatgggcctcatagacacacatgaaatccacaagcaatgtttgcttcactaacagctcattctgcttcctggtgctcactatcagctccacagtaccacacctactctactcctccctacacacatcacacatacaaaggaaacagtgttataagattataaaaatgctctcattgccaaaccacagtttaactgtgtcttaccataacaattcaacgtaccacagaccagcaccatttataaagaatattgacatagtttcacttaaaagcattaatgccctcagctcaagtaataatttgacaggaaaaaagtatccatgtgacaatgtacacataaaatcatgtagatcttccactaaaagatagggttcttcatgtttccttgccaggacagcttgtctgttttcctccctctgacccctaagacagggtttcactttatagtcacaactgacctggaactcgctatgaagaccaggctggcattgaattcaataggcctctgcctcctgagtgctgagattaaaggcatatgccaccctacctagcctcttatttttaatgacacccgcacttagatcattttttataatgctcatattctcttaagtaaagggcaggtaatacagaaaaacaagagtagttagagagtcattttaatatattagtatatgtctatgtattagagaaatttatttaagagtgctgtatttaccaatcaaccagggccattgaacatccaagagcctaatggaagcagatgtaatggcatataattgtcatatggaagcttagactggagagttgtagtttatttaggcaagcctaaataaaaccttgtctcaaaaataagacaaaataatttactgactatgaaagggcttttagatagccaaagcaaaccccaaacattcctcaccatcttaaccttttccccaggggtcattaaactcatccctaacctttctcctctctccctgaaacaaaggcctgatgttattagataacatctttctctattgacatttataaaatcctgtcagacctttatggcaaaaggaactttctttgtttaaaaccccttaagggactagagaaatggcttagcattaagagcacttgccgctcttgaggggaacagaactcccatcacttacatcaagtggctcacaagtggttccaggggaaccaaaacccttctctggcctccacaggcacctgcatttacatggcacacaagcatacactcatatctacacacatacacataaacaagaaaaaaagaaaaatgagtgacttcccgtggtcatatggcaagaagatagaaccccagcataatttttgagacatctagagaatccagcttcacctaacagaatttagaatggaaaaactagttttcaaagaggtgacagcaagaaaaagaaaacagtttcaaaggagaggcgagagaaacttcaggctagcagaccctgaagacattattaaaggcaaccaaacatagtaggacatcccttccctgagaggaattcaccttggtgattctctaccaacttgaaacaagccttcctgctgaatggaacctgtctcctgaagtaggggctgctgtgagaaaccttattggttctacttctataaagataccagaaaggacttccagaatgggatgggatccaaacacgcaggaaaaaaaaaaaaatccctgaacccaaatctgttgggttctcttgctattaactaacagagttaagtgctcacctataggcagtaactaattctgtttttctgagtgtgtggttgtctacatccctgctgatgtgccaccagtcctatattacttatgtgtgtattcaggctgtgtttgcatagtagtcatttatccaacaaaaatgtattttgaatgtcagatatattactaggtgctaaggctttattggagaaaatacgaatatgccaatgcctcctagaggtccctttctagttggggatataataatcaagaaaacaaagtaactgggaatatgtgttgtattggaaagaaaccaggcattgtggtgaataatgataacaggtgagatggaagtctgtcagacaatggtcaggggaagtctttctaagaaagtggtatttcagttgagtactgcaagattgaaggagcaagtatagtagcattcctcaaagtaatgccaggtaaggggagttctggagtaaaggtagagcaagaatgacagagtaataagcctgttctctttgttccattgtgcctttgaagggcctccttcttttcctgtacccctatatgcagggctcttgctcctccaggtgccaggtaggggtatttcctgcctctatcttgaactttttacagttcttcccttcccattcctgttttcctcttcagatctcctggaatgaaggggttgacctgtggtggcatgaactcatgcaagaagcaggggatgagtttgagcctgaatggtgtgatgctgaggacccactcttcatcttgtataccagtggctccacaggcaaacccaaggcaagtgtgtgcactgtataagggtgaggagtgagtttctgaggaagcttgggatgatcaacagaaactattagatgcagtactaggaatgtgagtgatacatgtgactcagatttctgagcatgtaagtggtcagtatatttatgttacatcagggtgtgataaaggagatggaagagagacaaatgctacaaaagtgcatcagcagggttagaatctttaaaaaggttcttcttccagctctgtgcaggctccatctgttggtcagtagagatggacacaaaaccccaacctgaggacccattctccccacagggtgtggtacacacaattggaggctacatgctctatgtggctacaactttcaagtatgtgtttgatttccacccggaggatgtgttctggtgtacagcagacattggctggatcactggtcattcctatgtcacctatgggccactggccaatggtgccaccagtgttttggtgagatgggacctgggacatggacaagatccttctgggtgacctcttcccaacgcttcttagactgaagaagggagacttatacagggacctacttcctggagaaagagcaatcctgaggggttgtatatcctactagaaagtttcttggcttgtgtaatcagagtttatcgtaaagacataactggtcaaaaggggcaaatactggtcctgaggggatggtagggggatggaaggactactgggaagggctaaaaataaccagatttcattggggtcagtttgaggggatccccacatacccagatgagagccgcttgtggagcattgtggacaaatacaaggtgaccaagttctacacggcaccaacagcaattcggatgctcatgaagtttggagatgagcctgtcaccaagtgagacccctccccatctgctatcccataggtatccttcagatctgagcagtcctttgtgcaatttctttctgttgtctcaactccctgacctggaataggggagggggcaaaggaatgctgaatgcatgtgtattttggctcctagtggtactcagaactttcctctcttccactctcccgcccaaggcatagccgggcatccttgcaggtgctgggcacagtaggtgaacccatcaaccctgaagcctggctatggtaccaccgggtagtaggttcccagcattgccccattgtagacaccttctggcaaacagaaacggtgagtaagtgattcaggaggcttagagacaatataggaaaatggactcaaacccctgatctctgacttccatagggtggccatatgctgacccctctccctggtgccacacccatgaaacctggttctgctgtgagtaaagtgcttctgctggtcctaggcttggcaagggatggagtttggggatttgggcctattagaaagtaaggtgctgggctgagagctatgaggaacttgggtctctggggctccttgtaagctgagtcacagttgcctcattcctcttcttggattgtgcctctcatttgcttttagtctttcccattctttggtgtagcacctgcaatcctgaatgagtctggggaagagctggaaggtgaagctgaaggttatctggtgagaatctgggatctttggggaagtaaagaggtctgctaacaatactttgttttagagtttacaccttatcgtcactggtagctgttagggacaaataaagttgagtttgtcctctgtggaaagacaccaatggaaatccttccaaacactttgcttgcatccttactctttggtacataggcttttaaggcctttctagagtatgttcccaggtttgtgatgatgctttggagtcaggaaagctgagtccagctcttccttggatacccatttctagagaaaggagtcttggtagcataaagaacaaccatgcaggttctgaagtcagcctgctgtattcagagtccatctctgcctcttctgtgacctcagacaaattgttacctcgtgcctttgaatgtaattttctcatttgcaaaattgggttataatatgtataaataatggtacattgtctcccatgttttattgaattagataatccatacacaaggattagctggagctagctgagcagtcagtgctcacagatgttagtgggtgcagtttttgtggagtagctgtcagatcccatcccgtcccatttcatttcatttttccaagatcaaatgaggaatagagacaggacttgaatctaagctttcttactcaatctagaattctgctgacacagagtactactggttagaaattacttattcactcatataggctgcatttttatatgacttgtttgcctttaataggacctgttttcctgaggaattacccaaaagaaaccccaattttccagatatttattactcacagaacactgtactaggcaattttcatatactatgaacttaacccttatagtaactttagaatttatttacttttatttacagataagggccctgaagttcagagaagcaacatagaattgggattccaagccaaactcatctatccccaaaccctatgctttgcactacttctcagggatggcatttagggtattttccttcaggtttagcaatgtgatggttgtcttcctgtgagatagcctagaggatgtgatcactgtaccttctgcacccctcaggtgttcaagcagccctggccagggatcatgcgcacaatttatgggaaccacacacgttttgagaccacgtactttaagaagttccctggctactatgtgacaggagatggtgagccttggctatcctgcccccattcctctctccaaaacacataccttcatttccattttcagaagagttgactagggatgaagagtagagaaagaaatatgccctgatgtctgtccctggtatccaggagagctatagtaaggctgtaagagcaggaatgagggctcaggacacttgttgagtggttaggagtactggctgctcctctagaggaccttagtttggtttccagcacccatgacaggtggcttacaaccacctgtaactccagctccataggatccaatgtcctctctgtccttggtagacacccccacacaagtggacacactcaaacacacacatacataaataatatatatacatatatgtaaataataaagaataattttttaaaaagtgcaagaatgagtgctgcaggaagagtctcagcatggtgccatctgagatcagattctggggatgacaggctcttattttttactctagtgttgacagaggtggggcatgtagaaatgggtattactatgatatgttcggcctcatgtctggagcctatttgtccattgtctgtctaccagttcatccatccatcagtattgagtgcctactatgaccgggcactgatctaatgaatacatggtatattactgtgaataacattgtcaaattctcttatcttatggggctcacattttagtaaggaggggacagacaataaaccaaatttattggttacaggttagtcataggtagagataagtgctatgaagaaaacaatgagatagtgcctccaagggtggtcagagaaggcttgtcctagtgatacttgaacagaggcctgagggttgaaaggggatatagcaggaagaaatctacagtaagagtattgtaaagagtggattcaaggcaggcattggtggcacatgcctttaatcccagcactggggaggcagaggcaggtggatctttgtgagttccaggtcagtctggtctacagagctatacaaagaaaccctgtgtcaaaaaaccaagagtggatacaagcttgaaattcacaaggaatggactgaagcctgtgaagctggagtgaaatacctagggaagaatgtcttattaagttggaagacaggttaggtaatagacaatactgtcatgttgacagggtaagcaacctagatttgattcaaagtacagttgaagagctgagatatggctcagttggtagagtacttgcctaagcatgcacagaattctggtttctgttcccagcaccacattaaactgggcacaatgcaatcttagcactttggaggcagaagcagaattaggattcagggccaactttgatacatagtgaatttgaggcctgcctggggtgcataagaccctgcctgaaaggggatgggagaatggagatatagctcagtatgcctagcgtacctgaagtcttaggcttagtcctcagtaaaacacacacacacacacacacacacacacacacacacacacacacacacacaccacacgattggggggggcagctaattagtatctggaaaataagtttgaatgttctaaaaatatatttgagattaggtagattatttattgtcatggaacaaattatgcccaaagttggcagcttcaaataacacatttcacctactttcttgaggatcaggatcagggagtgtcttggatgggtggttctcagtcagggtgtctcaggggttagaatcaagctgttagtgggggctgtagtcattgaaaagcttgactgagcctagagggtctgtttacatgctggtttacatggatttaggcagtaatccttcggcaactgtaagccacttaacatgggtgctggaaacatggttgcatgggtccttagttctcaggaaaaacagcaaatttaggcaggatctctccatagggaaactcacatggcatctggatacacctacaaatgatctaagagaatatgaccaagatggaacctaaaatgtcttcagtaagctaatctcagaagtgacatctatcatttctgccaaattctgctgatcacgtagattaatgaatggtatataatgagaaagaaggttgtagggctttaaatactaggagatggagatcagcagggccatcttggaggctggttgccaagccaaatgaaagtggaagcaggaaaatttgttaaaagattaccataactggtctaaagagctagttccaggacagcctccaaagccacagagaaactctgcttcgggggaaaaaaaaagattaccataactggtctaaagagctagttccaggacagcctccaaagccacagagaaactctgcttcgggggaaaaaaaaagattaccataagctactgtagtaggtgtggcagtttttatatcatgtaccctgctgtagggtctttactaggttgcatatttcttcccaggctgccggcgggatcaggatggctattactggatcactggcaggattgatgacatgctcaatgtatctggtgagagtcctgtatcccctcccatttcattagttctttcccccttgcaaatcctagcaaaaacttcaaagggagagcaaggactatcctactttgaaactgtggtgttgagtatggcattcagtcctgggcctaggatttggaggaaatgtataatgcacactaggatgctccaagagaggctctaagatggtcaagacatgcttggaggtgtgcatgtgaagaacgaaagccttccctatttgaccagattatgtcagccctgtgggtgcaatggagcaagaacaggggcaaggaagagctgagatccctctcatgcatttcccttctcttgacaaggacatcttctgagtacagcagaggtggaatcagcacttgtagaacatgaggctgttgcagaggcagctgtggtgggccaccctcatcctgtgaagggcgaatgcctctactgctttgtcactctgtgtgatggccacaccttcagctccaccctcactgaagaactcaagaagcagagtaaggagctttctggggcaggaactgaagggcctgcaagttactggggagaggctgcagcaaactacagactccaggggtcctgtggggtgactggtgtcttcccttagtctttcttcactagtcttcacactgggataataatagccaagagctttagaaaaccttctttgtgtcaccactgggatcagtgctttaaatgctttatcccatttaattcctataattaccttcacgaaatagatcctgttgttactctagttctaaagatgaagaaacttcaggtgcagagaactgcttgctcaaggctatgctgccagaggtctgatttaaactctagcaggctgattctagagaaagagctccatggacatgtattaaaataaaacaaaggagtaaagagacaccatgttaaaagagattagggaacagtaaacttcagaatgactctaggcagaactttaatcagctggggaaacaaagtcatggctttagaaagtctggctaaaggcactgaagatatgtttgataatttgttggttacagttagagaaaagattggtcccattgccacaccagactatatccagaatgcacctggcttgcctaaaacacgctcaggtaagtgtggagtcctccaaggattgggacgggctaaagcccagtggtggcaggtgtgtggatgggagtcctttaaagaacgggatcagtaagcactgttaccaagtaatcagaggtgtatgggttaccaggcaaaatcatgaggcgagtactccggaagattgctcagaatgaccatgacctgggggacacgtctacagtggctgacccatccgtcatcaatcatctcttcagtcaccgctgcctgaccacccagtgatcacgattcttgtccaggatttccctgtgtgtggctctccaaacttctgcccatccaccctgcacgctgccccggagtacaagggccaatgctggtttacactttgtttgaaactagggagacagtttcctagactgccaggtagaagggacagggcacaggtcaacctcagactgatatgctcctggactacagagaggtctccaagcccagaacagatacttaacaccatgtcctcaaccacagttagctagtcagagtgtaaatgagggccgagacagaagcagggcagtagctctaaccctttcagctttctaaagagcaccagttcttatcttggtcaaacccaagcctttcgaaatgacagcttgtgagtctatgaatgattattttttaaaattctttattgcttctgttctgagtctgaattctttgccagatggtagcacttgtctgttcatttgctagaaactgtgtgggtgggttcagtctccagagggttttcatatcatctgtctcattgaaagagtaagatatgctctgttcctagaaccaagggagttaacgttcctagtcctgccctatgaacagaaccctgcccacaaggggcactcttgagtgaaactttctttccttgtactttttgtgctcaagactaactggtgtaggaataaagttcatgagctcaagaagagagtcggctttctaaagtatctgtgtgttcactagctgctctgatgtgtgtagcagatgggaagaggactgctattccccagactgccccagaaaccttcatttgggcagaaccaggcaaagcttcgcccttaagcaagagcgatggaagccagcacaactatgacgtcacatcaggggtactccttcttgggaccctatcttgaccctataatcctctggaaacattagcaagtgactaagaattaggacttcagggtctgaaacccatgagacccccagagcaatcaagtcacctttcttgcatatccacctcccatgggctgccctcctccccttgatccatgaaacaatgaattgttgtatcatcattgttgctttatttagggcagagctggggaaagtctatgccctcctacccacttcttcctatcactcagtcctaccccaagtcaggcactagaacctgctggaaaggctcacaagagggtaataagatctgcagggcttatggcctttacctcaaagcagcttccttccccacactccaagatctggggatctccagaactcttctaatggaagcataactcttctggtcctcagatggaaggctgagagaaggtacccaggattttcccttccctgaagaccctggaggtctatggaaaagacaagttcccctaaggtggagacaggggtagccctcaggaattaggagaggaatgtcaagtacaggggatagaaggtctcttgagtgaagtgcaggatgtgccctcatacagggtaggggttgtccaggactgccactcctgcggccacacctccatctgcatgttcagtggctttggtccgaagcagatgccccacatgcttgttcatcacaagtgttgttccctgtctgtagaaatggggtcaggagacgtacaacattaggaaactaggcccttctctggtcccagctgactggcagattagaagtggctacattaagaaatgctaggactttagaatcagatttggagttgtatcctagcttggaaattattagcccttaagcttcctaaaaatgtccttaatttaaaattgagaaatacctcttatatttcaagatgatcatatggattaaataaagcaagaaaaaagcatatagcatgattcaggtgtacatttatgtcctgggctatacacttccgataactcaaggtgcctgatgacagaaggaatagtagtaaggagagtagcagtcagaatgctgcaagtggttagaaggggcatttgttgtaaggggaaggctgttgtggtagaaggcatggtagcatttgtgatgtctttaccttgccctgacctttgcaggaagttacattagggccttgttccttaccaattccaaagtcctcttttcttccttcctcttttgtcttttctttatttgaaatagggtctcgctatgtagccttggtggttcaggaactcaatggcctctaactcatagatatctgcatgtctctgcctcttaagttctgagacaaaaggtgtatactatcatgcctgctttcttcttgattcttagtattcaaatccaaattcagaagcccctcagtctttcaaagccactgaataccctcctctctctcacctttcatgggaattcccactggttttagagctggacccaaactttcatactctctggagtctcctattccttctgtccaaccatcatttctcaatcctcttggtggaatatggaatgtcctttacagttataaagcatgtctcttccaggatttacttgttagctctgtggaatgggtaagtcttgggtccttggccttacttaacagacaaagagacagttataaaactaggaactagcagagctgaaactgcagtccaggactcatggctctattcaagattcattctacactttcttggctggcactcttgtagggaagtagtagaaggagctgctcctgactagcttacctgacatagactccaaaaatacccagttctgagatacactggaccactcgggcagggctgccaggccgtagcaggcaattcccaaaaggctcaggttcaatcttctccatgaggatataggaggccctctcctcgctgtccttcagctgctccagagcttgcaccatttcctctccatacaggttattacctgcaattaaaatggccatcacacagcacacatctggcttctgagaaggaaaggtcatcttaacaagaaagctcttacacacgtgaacacacctgtcaccacactgttctgcctggtttgccccatctatggttcctcttaaatgtcggtattctctgggcctgggaagatggctcagtctgtaaagtgtttattgtgcaagcacaaagatctgagttctgatccccagaacccatgtaaagcaagcgtgggcacatgcatctgcacctctcccctctgctggggaagtgaaaggtgaaaggtgaaaggtaaagagagctggactcccacagctgctggctagctactagtctaacgagttggtgagttccaagttcagtgacagactactaaaaaaaaaggtggggagcaatagaggaagatatcaacccctgcatccacatgtatgcacgtatgtgaatatacatacacacatgtgaatacacatattcacacacaaagatgctaaggttctctaggaattctctacccctgctctgccctctatgtacttctgttcctaaggtttcatctacactgcatcactctcaaatctttaattcacactgtttgttctagaaatcagaagcatgtaccataggtctctactgcaaactcagcatatccaaatgaaaatctctttctgctagaacttgcttctcctgaatcttcctactcctaataaaatggaaggcttccctgagtcctatttaagttcactctccctgttacctatgttactatctcagaaatgtctccatctatgctcttgattgtcatagccctagctagcctgagcctctccatgggcctctcctgtgcctctcttcttgacaatggtatcagccttcttccatggtctctgtcacaaatatttcctctcattccaataaacttataaaggctgaagcactaagctttacaagttttcatcattgctaaacctacttggatcctggatagttcatgtgtcccttcccacttgaaactttaatggcttcctatctcagttatgataaaatacagtttatggcatatatttgtgtctatctgtgtactcacctatgcatatacatgtggaggcagacaccgatattgaggcatcttcttcaattgatataaaccttactttttgagacactaagcctggagcccagtttcagctagactgcctagccagtgagcctccaggatctgtcttcctttgccctccacccccaaagtcctagagggagagatgcctgccatcatgcttgtctttaaggtggaggtagggatccagtgcttgcatagtaaacactttattgactgagctacttccccaagcccaaatttcctgaaatattgtcagtgctctttataatcaggtccccaacagtcattcccagcccatattcctgccatctccaactcaagcctcatcaacctctagtccaatccatggtccactgcttttgcttaaatggtcttcagtttggaatgatcttaccccttttttacctggaaactcctacctatcccttaagacccaagtagaaaatcaagtctgtacgataaacatgatccctgccctcaaggagtttcacagtacacaggaatacagccaggtattcccttagaccttccagtatgcacccattctgtttctctatgatcttacaaactaaggttgtccaaattctccagtgttcatctaatcccctttactccacagggcttgcttccagggtgctgggagatatgctccattctgggatctgtgttgctttcttttgtaaccactaggcctgagactgtatccacatcaagtgccaataagcactggcaatagagtctttcactggacagctctacaaaggagatttacttacctccaccctctctctggggcttcagcacaaagtggttaggagcagcaagggcttcagcaatggcctggtccccttcttcaccctaataggaagcagaaagtagtcactagaattcaagctaatgaggcagctgaggtcctgctgatcatgcagagtggcatcagggagagggacagcagggaaaataattgtaaattcctttaggctagacactccaatctggatgtgaccgttaactccattgaagcactaaacatagaacaggccctttaagtcacttccctgggtttctatcgttatcacaatcattgctgaggaaatggatttaagctcccagattctggcctcaaggctcaagtgttgttcagagcaccaggatgtgagtcataatgccaactgtaatgccagctgccctgcatccttcccaacacactcaggtccaggtctcagctatgtggctatggtaggaaatacacactacataccatgtccaatgaatagaggccagcaaaggtggcacggaggcgggccacagcctcaggctgtcctgggagcagctcttccagcaggcccaccctgctcagttcctgctgcaccttcttggtcccagccagctgtgtggcaatgtccggacacttggcagcacatgatctctctagcagcagacgtgcttcccagttctgcagaggtaataagaccaaagggcctttactgaacaggtgccaggcactgtgccttttaatcttcaagctgactatcattacaacacccttgtgaggcagatatgacctcgaagtctgcagaattcttgcctttagcgaatttgtgaaagcaaactaatccaagttcacaattaaatgggaattactaacaaggaaatggctttggggaggagggacaaggtctcacagtgtagccttgtctggcctgaaacttcttgctacatagaacaggctggcctcagattcacagagatccacctgcctctgcctcctgagtcgtgagtgggattaaaggcgtgggccaccacatccagcagaaaatgcattttataagagaataggaaaatttgtgagcttttctccccacatccctctctctttcacccatcctattttgtgagacagagtctcacttggtagccaggctggcctgtaactccctaggtagcctgagcggtccttctgcctcagccttcagaatgctagatttgtcacttttttaacaggatctgattatggaacccaggctggcctgggactttctgagtgctgggattataaacacgtgccaccacacctggctggataaggtttgaagggcacgggacacttgattataagcttagcttcttattgtgctccaaataaaatccaacacttaaaaagctggttaaccatataacctttagtggccttttatccactaaagcccattccttaccatgatctacaagatcctgtgagaccgagttcccactggtttttcatctcatgctgctgcttccagctactcccctaactactgactcccatattctagccaaacaagtctgcaattatcaaatttcattccttcttcagggccttttatgtacccttttcttttgcccaaaattctctgctttttggctttttccatagatagttacatccttctcatcctcaagcctcggtttagttacttttcccctgaccattatacttaatgtggggttccccacaaccctctatcttttcatcctgttctttaggtcaaagccaattacctctcaactagggatcccccccaagctgggtatagtattacatatttgatttgtaaggctaacagagtatagtattacatagttgtaatgctaacactcaggtgattcagtagggtcttgagcacatagcagctcagttacaataatgagttccagggctatagaatatgagtctgtctcaataaacatagcaaaaccaaaactcaaaacatcatctgtctgttgcttttctttccggtgctcatctctctgacccggctgtgtagtcaccagaggaaccagacccgtggtgtctaccttgttttctattatttccccgcagcaaagcagtttctgacacttcacagtactcagtgtctgttattgttactcaatgaagtgcaatttgagtaattccctgacaataggcagtctgacaggtgaaactcactggagagtgggtcctcgggcaaacaggatcatgtgaacaaaggcctgcagctggctaatcacaggttgaatagtcctgttgtattaggagcttagaatacaagatacagggaaacatcagaggatcatgcctcggagctctggtccccatcctcaggcactgggtagaaaattgcccttgtcaagattacagacacctgtccagattacagatacctgtccacagctggatcaaggctgaagcctaaaatcccaaccacccacccagggctgtccataggagtagctttacctgatcctcaccagtcatctaactcctggcctgctgttttggtcagagtcatagaagcccataacagaagactagaaaaacatctcacagaagcacagaaagcaaaagttaaacccaagcatcatctaacaagtcacaaaagccttgtagctctatgtccatgttctaagggtaaacaaacttttctacacataccacttcctttcctttgttagcacaccctctcctcttctgcctctgtcctgaatcttggatccatttctcttctctagccagcaagttttcagtactctaaccacttctctggtcaaaaggacggtctctaaatctgtcctttagctgagctgtctcctgtagagctcagtccgcaggaactctaagtgaactataaatctcattttcaagtgtagcttgagatgtagctttgagaagctgagagtcgggcgggggtgggaaagctactcatagccatgactctcagatcacccatagtatttcatagcttctgttcagcattttaaaaagatttatttttaccttataaactttagagtgttttctgtatacacgtatgtgtactgtgtgtgcctggctcctgtagaggccaggtgctgggtctcctggaactggagttacagatggttataaactgccatatggttgagaaccaaacctgggtcctctacaaaagcagcccagtgctcctaactgctaaatctctccccagcccttatttctttttttaaatccaggaaagcagggatgttcagcctttcctccatgatatagatgccaacagtgggagagaagaatagcatattcagaatgtaatggtctgaatcagaaatcctggaaaattcttgtgggattttagacaagcctctgcatggctccaaaccttagtttcctcatctgtgtaatggggataataacaagtctcataggatggctgtaagaattaaataaaatgtatagaaagccaattttgaagctacttggtagttagcagatgaggtaatatcaaggttgtcactggctccgtattggtaatttcccactttagccacgagcatacctgagaacatgataaaacaaagagaccacagaaaaacctttctgagggctggagagatgactcagcagttaagagcactggctgctcttccagagaacctgtgttcaattcccagcaccaacatggcagctcacaactgtctgtaactcaagttccagaggaggtagcgccttcatacagatttacatgcaggcaaaacaccatcacacatgaaataaataaaaactttaaaaatatacttttattttattttatttttaaaaagcttcctgttcagataaatgagaattaaggaaaataaacatggtcagggaagctgggcatgacgacttacacctgtactgtcagcatctggtggctgataaaggagactgccattcatttgaggctacagagtttcaggtcagcctgggctacaaagggagagtttgctcctccctaccggaagaaaaagccacagaaaagaacaaattaaggtgggtgggtgggtggcctggaactcagctagtgagggctgactgtacccatctcttcctagatctttgctcagagttgttaaattgggtagctcaaaattacactatggaagtcagcagtttgtttgccaacttatctccaaaaaatgtgtgaatggctaaaacactacagatagattcctgaagattcagaccctaaagaccttgtagagtgaaaactaacacaaagcctgtaagaagaaaggtgtttccagcagcagatcccccccccccaagaaagaagtgagtcatagttgtgacgcctgagctgggtttctgtggagctctggtaggtccctggagggagagaatggtctaatagaaaaatactaacctgtgaattatactgactgggcatgtagccatctcggaagtaaaccacagcaacttcctgaccatccctgaaacaaaggatgaaaaaaagcttcggtatgaaattattactgatgtgctcaggggttcagtctatttcaggatacatcagagtacatgtggcagcccacaaggtaagcctgggaaaggaggggtttactagaattagtgcaagcagaaacctagtacttctattaaaaaccggtgtgcagcacacagtgctttagaatattctagagggaaacaagaaggttagcataggtaaaattaaaaacacacatatccaaaattttgggacatgcagaaactttaattaaaataagttcttccccgttcccttgatctattttatattatctagtttatctaataagtaaactagatactttgttttgttatgataacagcatattttgaaatatctaaagtgggattgtgaaagtccatggaggctcttaactttcttgttgctttgttttttgaggcagggcctcttatatcccaggttgaccttgagttcaatttatacctgagaatgagccagagccccagatgttcctacttccacttctcaaatgctagaattataaatgtgtgtgtgctctcacgcctggctacattcttttgtttttacaccgactctcactatgtacttttctatgtacttggaactttctatgtaaaccaggctggcctagaattcagagatctgcctgcctcagtctccagagtgttgaaactaaaggcatgtgccaccatgaccagccctggctaggtctaactatgtaaattgcagtaccaccccaatatgttgtactaatgctacagtgtgttggcccatgggaaaagtaggacctggcttagaagacaaatccaggctacagaccagagagtggtaaccagatggattagaatgagtctgcagctctacccacccagcccaactgctcaggcctgtcgaccagccacaaagagaggcaagaagacttttagaacctaaggttatcttgaaggatgctgatgcactcatccaaaaggtcaacagttgtgatataacccattagaagcagagcatggctaggcattcctaaaatttcctgtaaggatgagatatttcagaaattaggagaaaggaaaacaagctatcatatttcccagaagaaaggttctttagtgacaggaggtatcaagagaggttcttaacccagctgtctagtggctccttggggatgcttacatgaacagccttcggttttggtctagagaacccctttcagagacatcttcaaattttcgccggattacatggatgttcctggaaaagagaggtgagaaatcagaggtaatgggtgtggtgttttgaatggccctccacttggggccacacctgaaggtctcttcctttacttgcctgtccagtagctcattctctatggcacgctggtcaaatatgttcctttctttctcttgagcgatcagtagcaccacagcactagagaaagagcacaagtgagaaggggctgctacagagcttatccttcctgccgctcccttaaagtgaggtaggagcatggtttctcagtagtcctgctgatgcaggctgcaaccccagctcttggggcggggtgggggcaaaaagatcgtgaatttgaggccagtctgggctacatagcaagaccctgtgtcaaaacagaaaggagggactgaggaggtgactcagtcaggaaaatgcttgtcatgcaagcataaggacctgagtttgacctccagaacccacttaaaaaaaaaaaaaaaacaaaaacaaaaacaaaaagatgaagcatgtctgtcatgccatcactggggaagccgagacagggggaaatctggggcttgctggcaacctagtcttggcaaattgatgagctgcaagtttaatgagaaactctgtctcaaaaccaagatgaagagagactgaagaacacactacacattgacctggcctccacatgcatgtacacacaagacaagcagatagacagacagacagagacagaatatagcttctttgcaagaacagatgatgcctcaagttaggattgccaggggcaacaacacatttctttaaaacaggaaatttggaggtgaaaaagggagcctctcttgtctgttctctatggaagaaatattgtaatgatgtcaaatatctgtacaacttaaaattgagatttaaaaccatctaaccaaccgggcgttggtggtgcacgcctttaatcccggcactcgggaggtagaagcaggcggatctctgtgaattccagactaccctggtctacaagagctagttccaggacagcctccaaagccacagagaaaccctgcccccgcccccccaaaaaaccaacctcacccattttttccctagaagacatcttgagccatatatgatggcacactcttgtgatcccagcactcaggtagtgaagacaagagaattaggagtttaagactgacctgggccagtggtggcacatggctttaatcccaacacttgggaggcaaaggcaggcagagttcaaggcaggcagagttcaagaccagcctgaactgcaaagtgagttccaggacaactacggtacaacaacacagcaaaaaaaactaaaacctattttgaaaacaaaaacaaacaaaacaagactggcctgggctacacgaaaccgtatcttaaaacaaacaacagaaaccctagcacagtgatacagtaattcaaaaatctgtctgggagaataaacaccaagaatgttttgtaaatcaactcagattctaatgactgcattatcagacagtaaaaggatctgatccaagaggggagttcttagatgaaaaaacaaaagagctaaatggaactctccagagccaactacaaacaagccatcgtctctggggaccactcagccagcctgtgatgttcacagggccacatctggtctcacagtattaacaggatcactaaggctcactaggccttcctgctcctctctgtttacccacaagttccctaaagaagcaggggcttgcactttggcttactattctaagtatatattctgacctccttcgttgattggcctcttaatctacctgggcttttttttcaaccttagctgagcctcttagtctaaactgtgttcacctgacttctttctacttggctaaagtctcttccagcctgcctcaagtcaagaggacagacgggacattttagctgaaaactgactttaagctgggacctgcaagacaaagtggaagtggtttttcagaagccatcttgccttgagaggcccaagggcttgctcttcattttgtaccctgaaccactcggctcatgggtgtttggggtggttgggcaggatggcatcccgcccaggatggctcacctccaagaagaggtgaaggaggaagcctgaaggctggaggttaaaatggaatttcagactctggctaattaagtcagcttttccacttgccaaaccttgggagccagactcagaaaacacattctacctcctactgccttcagctctgagaaatttggactttgtagttgtcagttgaggaaggtgaactggaaatagcatgctggctgggagagaggacccaacactcttagtcggggctctgccagtgacttgtggtgtccttgagcaggtcagtcagcttctttccctgagccttaactgtctcatctatgaagtagatgtgttaatcagatcatatgtcccgatcttttaatatcaataatcatccttcttctactcattcaaactataggccctgtattttactgttgttgtcttaaagacttagttttatttgtgcatgcatgactgtgttgttgtatgccacgtagagctagagattcagatggttgtaatagaccctatgtgggtgctgggagtcaaactcaagtcctctggaagatcaagaatcacttttagcctcagagcatctctccagccctaggccctatgttttgaaaatatttgtttaaatgaaatcataattttacagacggttgtgagccacccatatgggaatataagccaggtccattgcaagcgcaataaatgctcttaacttctgaactaactctccagccccactgaaatcataattttataatcaggactggtggcacatggatgtagcttcctacttgggaggttagagcagaaggattgtcatgagttcaagaccaacgtaggctacataacaagacctgtctccaaaaagcaaacaagactggggatgtagctgagtggtggagtactctcctggcacacacaaggccctagatttgattctcagaatgacaaaaatagtttttttttttaaataaaacaaaattttaatcctcagattttttttctaaaaactttttattttttttgaggcagagtcttgctatatattcctggtaagacactgactatataacttagactagctttgaactaaaaggccagcctcctaactcagcttcctgagtactggatttacaggtgggttttttgtttgttttgtttttgtgaaaggatcttgatatatagagttggctggcctggaacttgctatgtagaccaagctggccttgaactcatagagacccacctgcctttgccttctgagtgctaagattaaaggcatctatcaccatggctagctcaagaaaaaaaaaatctcagagacaaaaaagaagtgccaaggtcacacgcttgctcagcagacgagcctcagccactctcacactgggtaaagccagtacctgctcaggagccacagtgcccttacccaccagtgcctacctctggacacatcagtgttttctccccaaattactcctaacctggcaagagactccctctgcagtgcttgtcattggcagtttctcaagtgatgtcactttcttaaaacggaacctggcagagggttctactggacatactgtttgtccaacttagggacagaacttgaggcttcttggaacttggtgaggcttagcaagcctaggaaggcttgcttggaggcaacagtgctattatacatgcaggttccaggagcttatcactgggttctactaccatctcaccatctgacttcaagcaagtcactgcacctctctgaacctcagtttcctgatctgtaagacaggaaagaggaacagcaccacctcagagcactcattctgagagctcagtgagagcctgcctggatgtgaacacttagtacaggtggactgtgctcacactgcgcagttgctagcagtggcctctcaactatctggaagtcacttacctagcatcttcacacatctggaacatggttgagaaataggaagaaagcaaagaaaacacttctaagcagttaaaatggacaccataaaattcccagatcaaaactgacatcacaaagaggtcctcatgctttttacacatgattagaacaacctggatccctgtttttccccaagccacagcaaattgggaggcagagggagagcagcagaggattcctattgcaagcacactgacggcagtaactgtaaaagtggatgttgaagaagccaacattacagataatgtatgggaactgaaagccagaggcacgggtgctttctgaccctcggtggcaccagtgcattgcaataagatgtgatcactgttatcacaatgaccctcacgccacaaggaaacagtaagttacgattagcctctctctagaaggaaacccagaactccactaaaatatttttggcacttaaatgtgtaagtttctattcctagaaacatccctttgtccccttctgatgtctagcaagggagaagctgccccacccatgaatgctaaccactgctacctttccacattcttacttagctgagccatagagctcccaggctttggcgattcccagggccagtcccttgctgggattattggagaggatcttggcagcttctttggtctttttcaggacgttgagaacatgtctggtggaagaaagacagcttctcagtaattggatggaccagggtacccttctgccatgacctcacagacacatacacaaaggaatagccaagtgcttaaaggctccttaccaccgttcctgaagcatccaccatagctgggatgtacatgcccagaggagtcctgagcccccatgtggccactccacccaactcagtttctaagggagcaggagcccttcaggtgctatatggaatcctgccgcagaccatatggaattgtaatgacctgaagcatcctgatggctaggaaaccactactgtggcccagctctcagacagaagcttctgaacgccctctgctttgggttaagaactgctcccaggcctcagatatgtcaggaccctcctatcagaggcctctggaaggctcactctgagcctggagtgttactttgcacagtgaggggcaggaccaatatgctatgaggtctcttctttctcggcatataaaagacctgatttcaagcagaaaactgctatgaggagaagatgcaggtgtggagaaaccaagactcaggaaggtacagtcacagaaggagatccttggcttaatcagtgactataggtccattgaactcttcccctaggaacccaccggtgcacagcaggagtccgggaggccaggcccccaaagctggcagagatagtgttgatttcaatctgtttcagggctttggagccatctgcgctgcactggaacatgtaatctgagcgattcaggcccaggaacacagtctgtggagaaaactgaaggctgaggacactggcccaggggctgactctggaggtctagccatactgcactctgcagagctaaggagaaccaccgaatacccccaacccagaaggaccattctgtcagcctcgaactgctctctggatggaggcccagtagagactagtccaggcatagtagattcctatgagaacagactgaggccacttctagtaaaaacaaaataccacagataagagagacaaggtccaggcaaaggaagggctaggaatggttacctgggcaatgccctctttcaggacttgcttgtagatatcaaagagacgggcagtgtagtcgtcctttttgatagtgctagagaagaaagaacattttctaggataaaagagacccttgaaaccccaggtcccatccctacccacccacttctagatagctttctaggtcttgaatacccattccaatcaagcagattattagtatctaataatctactctagagccagatgacctgggttcaaatccaagctctactagctactgtgtggtaatctcagggaatcccatcccctctctggttcttggtttgttcaactatgaagagaagaggaaaataactgcttataaaataggcttgtgaggaaaagtaaatgatgcagtatagttttgggttttgttttgttttgttttgtttttgtttttcgagacagggtttctagactgtcctggaactagctctgtagacctagtctggtcttgaactcacagagatctgactgcctctgcctctggagtgttgggattaaaggcgtgcgccaccactgcctggctacagtatagttttgaaaaattcaaacatcttgaataactgaaggctggtaagttttctgactgacatcaagttaactcttctccatagcttcccctgcattctagtcactgcccaggtaagtctctcctcctccatgacagtccccagggcagtttgctatgtacctgcaggtttttcaggcccaaggtttactgcatcagttaatccatgtgtgatatcatttccttggagaagcctcactatccaaaccagatcccttttcttttctttcttttttattatgtatgcagtgttctgtctacatatatcccagccggtcagaagagggcaccagatctcattacagatgtttgtgagtcaccatgtgggtgctgggaattgaactcaggacctctggaagagcagccagtgctcttaacctctgagccatctctccaatcccagatcccttttctaggtgctcccacagcactgtgaacatctcctttacagagctgactagagatgcaattctactttattatatggcaactaatatcatctctcccactgggctaaagacctcatgaaagtggggctaggtctaagtggactcatcagcttagcccagtgtgctgctgtggcgagtgctaggggctcatcctgtatggatttctggagccttaagaagaccaagagcagtatacagtcactaacaccacattgttgctcctaaagatttagggcaaccttgtcctcagccaagccaggcttgtaggctgatctagttatagaagtttgtggtggagccatttgtagtaggaaggtagctgtcttgaaggctgtctagaggatgacttctttcactggagcctttcttagctcttggtgagaagagtcccccagctgggctttagccacctagagaagtaggatacattttctcttctctgaagaggagatgcctttcaaccccaggctttaggctgttgttttcccttaggggctagctgtgatggtgtgtgtgtgtgtgtgtgtgtgttggtggcagggctcccacataatcacattgtcaagtgtaaatgcgctaaaccaggctgctcgtagtgagcataaagcaagccggtccagagaaagaaggtagtaacagggttcacatattcatgacctactagattgttggctccaaggcaatggttttcagacttaatatgattattatcccttctcagccgggtgttggtggtgcacacctttaatcccagcactcaggaggcagaggcaggtggatctctgtgagttcgaggccagcctggtctccagagtgagtgccaggataggctccaaagctacacagagaaaccctgtctcgaaaaacaaaaaaaaacaacaacaacaaaaaagagattattatcccttctcacattcaacctgttaccaaagagcacatcggagaaggatttggtctctaacaaaagaatctagttttccattgaaaatttaatcatagatacacaattatacacataaagtacatatataaaacattatatatatttaattctaaaataagcaatttatacttaattacaaaattaaccaagaaatttcacttgcatcaggacctgaagtgggaagaaaaagatctatcgggaagagacaaaggagtgactacctacttgcatcttgagtatggtttagtctgcattttgtcctacccaaagatatgaaactttaggtgacaagaaaaggtcattaaaaacattaaacacatccttctaatggagggattaaaaagaagggcctttgtttagaagttggacatctgactttaaaaacctccctggttttctccccaaacctggccattttccataattccaaatggagaccttttaaaggcgttattttattttatgtgtatgaatgcttcacctgtgtgtatataactatacttcatctagtgcccatggaggccagaagtgggtgttagatccccggaactaaacttatggaagactgtgacccaccaccatgtgggtgctgggaactgaaccccgatcatctgctgcagcaggacgtattcttaaccactgtgccatctccagccctcctgccccgatgacttttgtcatgggaagcaggggtcaccgatcacagaatcacagcaaccctaggtctcagccaacctcatgttgtcgactaagaaactgaggctttgagaagaactttccttttgcttgtcatacaaagagcagtggagccaggattagaaggtagctctcctcactccttttctacttttttttcctctctggggtacctgctccccactccaccaagtgagctaacacagcaacaactcgtagctccccaaccttcccatccaaagcttttagcttccctgaccccagaggccttagcacttagtacctagacagagtttgttccaggaaggccgagttctggctgacagcatccaccagcatgttgaaatccatctgcacagcataggcctgctccagcagagcactagggactggtgaggggaagagcgtgaacggggcataggtcaccacctgatcaatgagaatgtggggcagagagagagagagagagagagagagagaactgtgaatgggctatcttcttgcaaagtcaggcctatgcataactgagcacacaattgcagaacagcagttatttcaggaagggaagagatgagggaaaaaagcaagaaagggtacaaagacagtttccaggttctgttacaattctacaggattttctctaaatgagaggcaaaaacaaaataaaaacttccacaaaaactaagtacttactacatgcaaatcattgtgctgaatgcatacaatgggtcatcatataattctatgcagaaggtaactactgttatccatacttagcagacaaaggacttgagataggaattatgtaataggtctaaaatatattcactgctggtgtttggatttggaccaggatggttactaaaccactctaacacactcatactgcatgctcatccataccccactttcccctcctatgctcctgactgatatttaagccaagtccatccccacatcaggagttcacaccccaggcccctgaccttctggctggggtagagggaaaagcctgctggtagggctgctgaggtgaactgtggctccctgaatagaagccagtagtgacatgcccttgtcccagaaatgacaactcaggttaacaggttggcctttagttacactctgggttctttggactttacatggtcatgaaatcaaaataccatttaggacagttattcctaaaagggagaaacgccttctgagatttctaacaacaaatgaactggaacttgggagataattaatagatcataggaattgaattatttaccctctgagttaatatcaatttgccattgtggtagaaagggtttatggtggaagaagtttcattaatatacttactttaaaaactgccttgaactagataatacaaacaatcacacacaatttaaaagagttctaaatagctgggcagtggtggtacatgccttcaatcctagaactcaggaggcagaagcaggcagatcctgtgagttcaaggccagcttggtctacacagttagatccaggacagtcagggatatgtagagagaccctgtctcaaacaaacaaacaaacaaataataaaagagctaagggtacacagtgagaagtgtatcttagtcccactgtggcctgagtcatctagtcctcttcccaagacacaatgtatacttgtgtcagatatctttataactgatatatatgtttccaaatacatcatcccctttttacacatgcagaaagattctgcctcaaaaacacaggaacagggttattgcaggtcatgtaaaggtgacctaacacccaaaatgcatgtaagacaacaacaggttttaagactcaggactcgggagattgcctctccaaaaatttcccagaggttttctgccaagccttctgtctgtcctgaccccagaactcattgtaccttcttgaatttaggatgaacagcacatagttgttctctgctgtccacaggccaaaggctgaaacacacagtctctcactttttagagaaaaaaaaaatagcacacatatgacaataacactctgctttgttgccagggaaacaacaggaatggtgagatggtgaggataagcagttgcatcttagcccacaggctggcctcactagaggctagggtgagcttaaacctcttttaaaaattatatgactatttatttctgtgcgtgttttctatcgaatgccatgtgaagatcagaggacactttctgggaattgattctttccttctaccactaggttatggaatcaaattctggtcctaaagcttagtggcaaatgtctttacccactgagccatctagtggcccagtcttgaacttctattcctcctgattgcacttccccaatgttgggattacaggtatgtgctaccacagcctgccagtttgatttggatagtttagcggtgtaactttccattattattactaattattattatgttatttgcatgtgtgtgtggtgtatatacttgttagcgtgggagagcacatgtgtattcagagttgggtatcttttccttgactgatctccacctttatttttgaagacaaggtctctcactaaacctgaaactctgatttgccagaacaaacttcagagatctgcctgtcttccagccctggggttccaggtatctactactgtctcaggtgtggattctggaatctgaactcagtttctcatgcttgcttagcaggtatttcacataacaacccatctccccagcccctactggagagaagggttatgttttaatgttggctctgacttaaaaaaaaaaaaaaaatgtcgctgcggggctggagaaacagctcagaggtccttgcagaggacctcagttcaactcccaataccggcatggcagctcacaaccatctgaaacgacagttccaggggactgaagcctcttctgccctttgtaggtagtgcacacacattcacctgggcacacacacatacacataaaacaaaaataaatattacaaaataaaaatgctggtaaattaaaaaaaaaaggaagacacaaccctaacaaaaatttgatgaaggcttgcctctgagggaaacagtggctggagaagagaacctttctctacattgactgcttttgaacagtatgcctagctcatgtgtgacctattcaaaatgaactcactctggtccccgaatggagctggtctgctatgctgatctatgctgatctatgaagtgaaggtcacagtcctctctgcctagtatcaaaaagcctcttggctttctgactttgcctgacgtcacccactgacaagccctgcctggaacattttggcctctccctactttggaggccctgccatattattactttcccccatctgcttttaagctccaatttaactttcattctccattttgcctctaataaaaatgaactgctacttctaccaggcatcctgagagagacagtgaagtggggatatgcagagcatggcctcagcagccagaccctgccagtcttcccatgatttcagtgaccccagtcaagttacttaacttctctgagcttcgacttcttcctctctgttgcggtgcaggttaaatgagtcagcaatcccaaagtgttgagaataatgcctaccacacagtgagtcgtcaatagatgacagttgatgctgtactgagcacgggccacacctcctcctccaatgacattccctaattttattctctggtacattctccaactaaaccctgtgcttcaaaggttgagaacctctggctgactcacctaatcttccatgtcaaggctgtctggcatagagcagggtacaggttagaacagaatttattttaaatgatttatttttattttgtgtgcactggtgttttgctggcatgtatgtctgtgagagggtgtccaatcccctgcaactggagttggaagctgtagtgtgggtgctgggaactgaaccccagttggtgatcttaactgctgagctatctctccagcctcgtctttttctcttgattaggaatctcacttaggagggccagagagacagcttagtggataaaaacaaaaccaacaacaatacaactggatttagtactgcacatatgttatcctagcactcctaggatgagatggcaagcaaagacaggtgaactatttggaacccccaggcaagccagcctggaatacacagtacagcggcagaaaggtggaaggtgagaaccgattccaaaagttgtcctctgacccacacatgcatactatggcacatgggtgcctgcattcacacatatatacatacatacatacatacatacatacatacatacatacatacacacacacacaagctcttacgcacaataatagatttttaaataaagagagccgattcgggattccttctgtacatatgtttctcttatgggttgatgaataaaatgctgactggccagtagccaggcaggaagtataggtggggctaccagaccaggagaattctggctagaggttggagagacaggttgtgagggagaagccaagtagctgctgaaggagtatcatggtgaattacgggtaagccacagcctcgtggcaatacatagtttaatagaaatgggttaataattaagagaaagctagccaacaaaaagcctgagccattggccaaacagtttataattaatatgtttttgtgcgcttacttgggctaatcagctgtggggccaggcagaaaagaaactccgtcgacatctcactgagagtcagggaagttgatctaaaatctcaggacttggaggctgaggcaggagcattgccataagttccaggctccatttcaaaactatccccatttccccaaagaaagaagcctcattgaggactgtgccttttgtaggccccattaaaccccagaaagattaaatattaaacttttatacgatacccatttattaatagaagaaataaaaactcgaacaagaatacattccatcttgattccaacaattcataaacctaagttcctagaccatacaatactatttccaaaaccagagaccagcagggtggtggtggtacatgcctttactcccagcactcagcaggcagaggaaggctgttagttcaaggccagcctggtctacagagcgagttccaggacagctagggctattatgcagagaaactctgccttgaaaaacaacaacaacaacaaaaaccaaaccagaggccaaccttccacagtatcaggcagcagtcagtaatggccactctcaagtatttgagcttcagcaagtatacctgagtcttgacaatccaccaggcccacatctgagccacacagagacaacaacaacagcaaaagcatgtggctaggttaaagacaacaatgctggcacctcttcagtaaccagtgtgggtggtgttaacgtaaatggcagggagagagacagaaaggaagcaagaaaggaaggacggaaaagaaagaagcacaagacagaaaagctgatctgttacatgcctttacatacaaagagggagagagggctgggtgtggcggtatatgacagtaagcacagccactcagaggctgaggcaggagaatagagagtttgaggctggcatagactatacgtctcaaaacaaacaaaaaattggagtaataacaagtaaatacctagttatttacttgttactcatgaactacctggaaggataagcaagacactaagcacagactgcctttaggacaggggagttgggtagacaggggatgtggaacagagggttagccaactcttagaacttctgaatcttgacataggaaaatgttcttgaatgttaaattaattagttgcaaaataaactgatttctttttgctttgttttttaaattatttattttattttatgtgcattggtgtttttgcccacccgtgtatctgtaggagttgcaattatagactgtggtgagctgccatgtgggtgctgggaattgaacctgggtcctcaggaagagcaactagtggtcttaaccgctgagccatctctccaaccccagctttgttttgctttaaggatagtggtttttggtttgggtgtctattgttttgagataatatctcagtatgtgatcaaactgcttttaagtgatcctcctgcctgtgacaaggcccagctaaaggaggagatttttaagtttggttacagcgggttctctatatttacaagccagtcctagagaaacacatacagagctgcccaagcaaacatgcatgattccttgttgtgctatctgcaaatatagagctccctaaatagccattggtacagcaaagttaaactgtgattcatccacactgaaacactacaacagaatgaaattgtccctgagtagttatcttcatacatataaactaaaatgtgtcagtgtgcagcaagacctgatgacaagcagtgaaagttgggaacacggatgggactgtgtagagttctaccctgaaagtgtcagcagtttatagttgtaaggctaactgcaagtgtcacagaaaagttgtatattcaggacagacccaaaccaacagatcagtgcttcaaaaattgggaaagtgtggcgttaacacgagcacatttggcttatacataagtaagtgaacatgataatttgattgagttcttttggccacataacatgttaataataacaggaaatttggctatcttcataattatgataagtataataccaaatgataatgtatgggcaatagtaggtatctctaacaaagttatttctaaaaaatgatacactaagctgggtggtggtagtgcacacctttaatcccagcactcggaagcagagatgagtgaatctctgagtttcaggccagcctcctctacagagcaagttccaggacagtcagggatacacagaaaaaccctatctcaaacaaacaaaaaaaccaaaccaaaaccaaaacaacaacaaaaacaccctgctaaatttcttttaaagtatttgtagaatgaaggctgtaaggtaagagccaaccctgaatttaaacaaaactttgccttttgacttcattcatcagtttatttaatagactatttttaattataaaataaaatatgctagagccagcggtggtggtgcacacctttagtcccagtcagggggcagaggcaggagaatctctgagtttaaggccagcctggtctacagagtgagttccaggacagttagagctacactgagaaaccctgtctcaaaaaagccaaaaaaacaaaacaccaaattgctgcctgacaaaatgacatatttaatgtaccaatgagtgtttaatctttgcaccacagaacagatacattcaaataacattaagtgttactgcatatttataaatgtgacataattatggcattaggggaaagtatgactaagagcaaatagaataagcagctaagtgagaactaaaatttggcctttacttttaaacatttaatttcttataactcttgggaataaaaataaactgatattgtttttatcaaaaacatgcagaagggctggagagatggctcagcggttgagagcgctgactgttcttccagaggtcctgaattcaattcccagcaaccacatggtggctcacaaccaccttgaatgagatccagtgccctctgctggcatgcaggcagaagacagtatacataataaataaataaataaataaataaataaaatattaaaaaatattaaaaaaacatgcagaagactaatttcttagaaagagatttaagacagactgctaaacaaaaattaaaaatacatcatagaataatacatatggttcaacttggattttaaattacacatatatgtatattttatattttaaatgatacaaattacatatatatatatgcaaagaagctgaaggagtatataaagagtatataaagctaggcatggtgctgcatacttagcagggacaagcgggagggctgccatgagttcaaagccctcctgctctacacagtgagttttaggtcagttagggctccatgatgagattctgtttcaaaaacaaaacaaaaaagagcaattgcagagaagacaagtgattgggggtgcttgatacataatagttcccctgacaaagtgcttcctggaaattatctcctgattatcttatgccatcaattatataataatattctgttcacctattggaggaaagtacaactcacagaaatgaagtagctgcctaaattacacttcaaaccccagattttgattattccagcatgcttctttttactttacatacttttagaaatcaattttagctgttgaataaataaaggagagatgtggtctttggctcaaaggggctgcccccaccctgggagggcgggctctaagtggcattttgaagcttacttgagaggagctgggactctccgcaggcctcagcaccacgccctcagccaaggcccggtctatggcctgctgtgccaactcctcaagctgtttctcatcttgcaagatgctcccccagctggtggccatcccaacctgtgaagacaagagggcttggtgacagaaggcctagggctcagcagccattgaaaggtggctacatccatactgtgagacttgaccggttcccgtggaggggcaattgtggcagggaacatactgcttccacttcctccctgtacacaaaacaagttgacacagtatttccatggctattcatcctctctttgaattctcagtaacaatggcattattctcacagtgaggaagcaaaggttcagagaagagaaatgacttgctctaggcaatggcaggtctagctggtgtttaagtccaggtctctggacttcctgaccaaaactcctcaacggagacagaggcgctaacgccatatgtgactggtaacgctgtatgtgacaagtaacttcccctcccagaactacagattccctaagtgggaagggataaatgagtggtttccaaacctggcttaacattctgggttgagtgggaaaaaaatacttattactgggccccaccccagagattatgattgaaggggatcagtgagaggaaggggtggaaattgcattttaaaatgttttccttagatagaaaccattgtggcaaatcgttaatttcccttctttaaatctttctattaatttatttattagtgtgtgtgtgtgtgtgtatgttgccatggaacacttggtaaaggtcagacaacaatctgcaagtcagttcttgcttcccatcatgtgggtctctgggatcaaactgaggtcatcaaccttggtggcaaacacctttacctaatgagtcatctctcttggcgctaatttcctttcttattctgacaacctgcatcagtagatctcaaactacatagtggatagggaggaaactgtggagtatcatgaaatggagtcaaagaagtatcactgtgattggcttaataaagagctgaatgaccaatagccagacaggaattagcctagctgggacttctggggacagagaggtcttggagaagaagaaaggcagagtcgacagccagctgtggaagaaccaggatgggcaggacagagtaaaggtaactgagacacgtaaaagaatgtagattttaaaatatgggttaatttaagttataagagctagtggggcaagcctaagctaaggccacattttcacacacaaaaaataaatgtacagtttctcccttatacgaaccaggagccatttttttcttttaatttttatttaaattagaaacaatcttattttacataccaatcccagttccctctcgtcctcccatccccccactaatcaattcccatcccatccccccatcttctccttccccaccaatcccccatcccatcccacatccactcctcagggagggtaaggtctcccaaggggaataatcaaagtctgtctcccccatgtatctagggaaagagagtatcccttcacagggaatgggctcccaaagcccattcgtgcactagggataaatactggttccaccgccagaggccccatagactgcccaggccccgcaactgacacccatgttcagagggcctggttcggtgacagctgggtctgtgagctcccaattgcccaggtcagctgtttctgtgggtttccccagcatcaccagatctcattacagatggttttgagccaccatgtggttgttgggaattgaactcaggacctctggaagagctcttaacctctgagccatctctccagcccttaagccaggagccaatttactagcacaaaacaattacatctttctgtagacatttatcaccatagtttaaaagggacaaaaaatatttttaagaaatcacattattgttaatcccagcacttgggagacagaggcaggtaggtctctgtgagcccaaggccagcttgttctacagagtgagttccaggtaagagctacacagagaaaccctgtcttgaaaaacaaaaacaaaacaaggaaggaagggagggaaagggggagggagggagagggggaaggagggagagggggaggaagggaaagaaatcacattatcagggtagaaatacccgaaacccagctgcccagcctagtgaaggagaagtactctctctgccttgctgccagaggtactcagaagtataccagcttacccattcattttgcagcaggttttggggttcagaggatctggataaaaatctggaaacatctggtcactatttttgttctaccctgctgtcatttaattctaagaaacaaacatggctgctcaactcagtggttgtcaggaagagaattagaaaatgatagataacttccatcattttcagcctctgtctccttctcctcatggtgaccttgttatagaacatccatctaagtgggccagcctcagcacaatgctttgacagaatgatcatgtgatctcaacacggtccaaacaattggagacagctgtcagagtaaagaacaagacttggagtccgacagacttgggtgtaagcctataacctgacttcccacataagggcaccgtggactaaatgagaaaaattaatgatgttttagcatgttcagcttttagtagccagtcttctgtttgtatagggaaagacctgaatctggataactttataaagaggcttattatttgagcatgctggtacattgtctatggtcctgtgaaagcaggggcatttctgaaagttcaaagctagcctgagctacatactgagtgccaggccagccagggatatatagcaaggtactgtctcaaaaaatacttatttatttacacacagagatttgcctgcctttgcttccagagtgctgggattaaaggtgtggaccaccactgccaggcttaaaaaatatttcaagtaagttttattacttttttttctggtcaggattttgctatgtcattcaggctggcctccaactcagcaatccttcgatcacccaagcaatggcatcacaagaatgagccaccacacccagctgaagagttcactgactataagttctatgttttgaatgctgcagggcatggtgctggctttggtgaggactccctggccgacagcctttccatagttcgtaaatgagcaggaaggaaccaacagggtgactcaggatcactcattacaactcactcttctctcactcctcacaggggcagctccctaatgatctagggacaaaccacctggtctcacctcttaagggtcccaccacctcccaaagtcaccacactgggcaccaagcccaacacatgaacccatagcagagttctatacacaggaatatgtctttgctgtgttcacttcataagcagtgggagacttgttacaggtcatatagaaacctagtggcagagccagaataggaactcatggctccaacattacatcaactggacctccatttgagtctctacacactgagaaattccaaagctgtctgttgctgggctttgcttatctgacaacaatgctaatgcgaggctcttggctaggtgctagggacattaacaataattacttaggatgggatggtggcacaggcctgtaattccagcactcagaaggtaggggcaggaggaccatgagtttggggccagcctggcctacacagcaagaccctgtgtcagtaataataataacagagctgagcaacggctcagttggtaaagtgctggccacccaagaggacttgctccccagcacccataaaagatggccacagtagtgtggtactcttctgaaatcccactgccaaggaggttgtgacagctggacctctggaggttgccatcagtgagtgtgagtgaactccaggtttagtaagaccctgtctttagaaagttcggcagagggctggggaggtgactcagcaggtaaagaggctttccatgcaagcatgaggaccggagttcagatccccagaacccacacaaatgctgggcaggtgggggtggcctgtaatcccagaatttgaggggcagagacagagataaagtggagagtgatccaggcagacatatgatgttcgggtcccacatgtatgtatgtgcacatacaaatgcaccctcacatgcaaacactgagacacacatctgtacacacacacacacacacacacacacacacacacacaactgagggaaaacaaagtgttgactttgggcatccatgcatacacatgcacacaaacactacaatagtaacaacaactagaaaactgctaactgggtctcttgtttttctttctagagatttaacccttctgtgacttgtttgcctgatgacactttgtgtttttgtattttcaccgtaagtacttccttgattttcaaacagagcatttggctgctccctgggatgcttctcctctgacgaatctcaccttggcacccaagccctcccccccacccccgtgcacttttctcccacgtcccatctcttccagtcctgtggattctgctgactaaacgcagcgctttgaattcctctcgtctgcctccactgatctagacgagcactggccaaccctctcctcttccctgggcactaaatagattcagagtagttacaccagcctctctcccacttccagatcttggctgatgctggtttccctgtggctgaaaggctgtcccttctggaccagccccaactcccgatgtagttttggaagccatccctggacctctctgtccagccaggttcgtatctataccataaaaagagcatctgtcttgatacttctcagctagtactagatcatagtagtcagtgaaggttaaataagtagtgatgaatgaatcaccaagaactttaaaacgcccacacagaaatccggtcggactttaatcccaggggcgaggccagtggggacgcagggcctcgagctacgacagggtcgccggccttggcttgtccccatgatgggccccgttcactccccacccctgaacaaagtttggtcctgatctctcccggttgttgatggtggcttttaaaattttttctggaactctggctctcgcctctttgaccgcgtccgggctggaagcaggcgagctagaaatctaggttcagcacgcgccagcccaacccccgcactggacacaagtttccccggcgccggccgccgccccacccaccgcgcccgcccgcccggcnnnnnnnnnnnnnnnnnnnnnnngccgccgtcgccgagccccgacctactcgttcgttgtccagctgctcgccaagctcaaactcctctcgccgttacccaggctcagggggcggggccttggcaccaccctgtgcgcctgcgcagactgccccgctgggcataaagaggagggtggggaaggagcctcgcgtctgtgaagccggacggcggccgggaaggggcactccgtgagaagcgacctgggctttagggatatatccataccctggggtgtgacaggctttgggaagtagggaaggggtgtgactcatcggcgggggggggcctgtaggcttagatctcggagagtcagagcctcctgtgatttggggacactcagtgtagaatagggtgtcgggtctcctggcgaccgaaccgggtcctctgcaaaagcaacaagtacccttaactgccctctccccggccccgtggggctgtttttaaatatgcagcttcatgaccctcttacccctacacagacccctcatcctctggcaatccgcagccatttaactttcttattcctagataatgagaggtttgttaaaatctgaggcacctgatttaaaaaatgtgtctgaccaaaccctagggaattaattatgactaagataccaaactcctaactggtttggtgtaaataaaagatgagctctagagtgtggggcagactgttaagagcctggggactggagttttagcatggaaaagagagttttctttgttaggttccagcaggtgctggccagatttcaggtgtgagggccaggcaatgaggctgaggcaggccatggttgtggagctagagacaggggatgttaaattgaagagtcttaggagggagatttgttactgactgtaaatcagtggcccaacccagaggccagaatccttccaacttcctagataaagcacatacatctctccctaggacagacagccttccagacttgtgtataaactcaagagaattggcagataggtggtctggtaattgccaaaagagtgtttgctgtctgaaccgttttccttgtcactattgtgcctgaccaggtaggaagcagcagccccagtagccggtgaaggtaaccatttctaaagcataatgaaattacaataagcagggggtcttgggcttgagcctttaatcccagctctcgggaggctgaggcaggagaatctcaatgagttctagctcaacctagtttacataataacagttccagaccagccaaagttagttggtatgcccttgtctcaaaaccaaaacaaacaaaaaatgaattataataaaaactaaagcaccatgacccatggctcactgtacaggtgcctctctaagatggaccagcaatgatatacctattgattacgggtgaaatatgggcaggatcctagatcttaacagccctttggctgagtctcctcacattgtggcttcatttccattttgtagatggcagctgagcctgagaagttacctaactgttcaaagtggtgtatagtgagaatgggaatgaagagccgaaggcttagcccttcctactcctctgcgatttactgtcattcagatgtttgcccccttggatgccaccccactttgtcactctgtctcagagcagctattagcacctgagattacttctctttgtttgttgtttccatcctgtgggtgtgaattccatcagcatggccattatctgtcttgttcactaccccctggaagggaaaaacaagcaacttcaacagtaaagcaggtttagcctgagaaaatatcaaaaccttcaaaagggagatctcttacagcaatgattctaacctgtgagtctgagacctttggggatggaatgaccctttcacaggggtcacctaagtccatccgaatatcagatatttacattatgattcataacagtagcaaaatgacagttatgaagtaacaacaaacataattttatggttggggtcagcacaacatgaactgtactacagggttgaagcattaggaaggttgagaaccacttccctagaccctggaatggtgcctgaaatgatgatctaacaggatgggagagagggaggtggatactgagattagtgaaaactaagatacctcaggtgcttctcacaagttccaaggtaaacattatctccattaattggtttgtttaggtttgaggctgtagctcagttggtagaatgtttgctggtgtgcatgaagccctgggtttgataaccagctccacataaaccatgtgtgtggtggacatctgtaatcctaccatttggaaagtgggggcaggaagattggaagttcaagagtatcataggctacctttctcaaaaaacaacaacaaaccctattcatattcactggacaaagatgtcagtgtataccatgtggagaaatgaaaagatctaagatcatcaaatccagtatggaggattgggatgtattgtagtatcgtggtgtcaggctcagggtttgatccctagcatcccctcaaaaaggatttacaaggctcccacttagctccatcatgaacatgtctttaaaggctggtcacagtggtgtgtatctataactccagcaacttgggaggctgaagcagtaggatcatgaggccgtcctgggctgtacatagattgcatccccaaacagaaacccaggatgagggagttttcccagggtcttcctggccccatgcctttgctattgcatatagtaaacaccagagaacctagctgaagattctgcagagggcgataaggatgcaatgagccttggtatctaagatctgagttcaaatcccaactccacaacggagcactgtgactacagcaagccctgggtttaataacccaagccctgggtctctaaatcccacagcctgacttctaaagtggagtaatttttccttgtctaactgctctttattgcagtggtcacaagtgctaggagcttggctagttccttctcaccacaaggttaggagtccagtagtgttacggtctccatttgtacagcagggaagtggaggcatgaagaggtgtcctgctttgccagacttcacacagctctgcacacgtagccactggccctcttcctatgctttgggatgaggtcaggcttcccagagatgactgttgaatccgatgaagtctatgttgaagggcttgtgggaacatttgagtatgaattaggcagaagactgcctttaactttgtgctctgcatttgccctgtgagggcctctccaagtctcagttggctttatggagagggaggttgagacaaggtctcatgtaccttgttatggagctgaagatcttgaactcctgatcctcctgcctctacttcccaagtgttgggattataggcttgtgtcatcatcacaccacactgagctttggtctggccttttgattgagacacctcccattgtcccagggtctgcattgcacatggctgatgtctctctttagccatgacatcaccccttctggctctacagtttatgaggctatctatctctccacctggctgggggccactgcttcagctactcagagtggaattcctttgccttccagcctctagcacgggcctggcccagacttgctgctcaggaaatgcctgtggaatcaaagtgggactcttacatgtgttgaggattcactatgtgccaggcctatcctgacactttatatgtgctgtctcgtttacactcccgcagtaatcctgggagggagacattattgttcttattttactgagaagaaatagagaagctggactctgttgtaggcctacttgtcattgttgttaggcccaaaaccggttctaggcagtgcttctcaacctgagggtcatgactcttttgggggtcaaatgccactttcacaggagccaccaagaccatcagaaaacacagatatttacattaccatttataacagtagcaaaatgacagttatgaagtaacattgaaaatcatgttacggttggggctcagcacaatgtgaggagctgtgttaaggggcacagtgtcaagagattgagaaccgctgctcataaactggggaggctgccacttctatgccccaggaccctcagagaaatatcacaaattctggtctggctctaacttgatttacaagcaaataaaagtcccagaaaagtcagaagactaggctagtgagaaggctcctcaggatgtggcttttgtcactgggtctgaagatctgagttcaatccccaggactcacaaggtgcaaggaagaactgaatcccacaagttgtcctttcaatcccgtaagtgtgctgtgactcatgggtgtgcacaaacacaactaaatccatgtaaaagaataaccttataaccattctgaacatttcatatgaatggaatcctatcccgtgtgacctttgtgactttcccttggccagcatgatgtaatctggatcagagctttgctcctaggactggagagatgactcaagggttaagagcactggctgctcttgcagaagaccactgttcagttcccagatctcataaggcagctaactccacttgcagtgaaccccaaaccctcttctggctttatcaggcaccaggtaagtatatggtacacactcatatgtgcagacaacaggaaaaagaaaaactccatccctttgagttgaatactcaatttgtgaatataccattttgttcattagcttaaggcatttgagatgttttccctttgtaaacatttttttttcctcttaaaagagtctcattatgtagccttggccagcctggaattcacaatgtagactaagctggcctcaaattcacagaaatcagcctgcctctgcctctgcctctgcctctgaaattaaaggcgtgtgccaccctgcctagcctgttttcactttttgctattctaaatgttgctaacatccacatacatgtctgtgtgtgaacattacctcttagagtccactggagacgcccaggagtgaaattgctgagtcatgctacctacaagttaaatcctttaaggaattgccaactgttttccaaaatggcagtggtatatgagttctggtttttcatcttctctactacttgtctgtctgattgtagtcctctaaagtagggtgaaagatctcattgtgggtctcaggctggcctccaactcttacgttgttaaagctcctctgtggtctctgtttctgttcctgcctaggcttcccttgatggtggactgtgtgctggctagtctcatgtcaacttgacacaagctaggatcatctgaaaggagggaacctcaattaagaaattgcttccataagatctggctgaaggcaaacctgtagggcattttcttagctaataattgatgaaggagggaccaactgttttgtgtggtgctgaccctgggatggtgtcctaggtgctataagaaacaggtgaaccacaccatgagaagcaagccatggcctctgcatcagtcctgcctccaagttcctgctctgagttcctgcctcaatggactgtcacctataagtcaaagttgcttttagtcagtgtttaccccagtaacagagaagcaaactagaacaccaagtctcagaattgtccattgttagttattattatttcttctcatctactgcttgagaagtgacagttcactgtggcttcccagattaatacatatttttcattatacctgtgtggttagatgctgcttggagcctctgaagtaagaacactttctgtggctggagcttcagggctctgtgtctagactctgttggctgtgcagagggagactggaatagggaatgttaaggagggtgaggactatagggagagggctgttgtcaccttgagccctgtggtggaaggaagctaaagttccatctccttctaccctgtgttattaaaaaattaaaccaaacaaaggagccaaagtcttaatctgaagacctaaaacaatgaaactcttaagagaaaacccaggtgacactcatggggatcataagttcaccgatgctctcttagatacaatagtcaagaggggtatagaggcacatgccagtaaccacaacacccagggtcgcacaagaggattgcaactgtgaggtcagtctgggccacataacaaaaactaccctcatactaggcatggtgacacatgcctttaatcccagcactcaggaggcagaggcaggtagatctctgtgaccttgcacagagagaagtggccacagagaccacaaaaccaagaagatgcctatggcacccacagttgctggcatgacctttttcttctcatgacctctgtgatggtgagttgtggactttccttgcttgttctcctgaaatgagatggtagtaataagaaaagtaattagtggatacttattataagtggcgagttggcgttgtgtttgttctttttaaaggtgtgttatcttactcctgagggaacagctgctgtctcagaggcagggtaattggggtttacacacagacagcccgactccagtgctgtattgttagcctggctcaaaagaacaaaggaagatgagcaagcttggcaacaagtgtaataaattaaaaatttgggtgcatgccaggtgtggtaatgcacacctttaattccagaatttagaaacaagtttgagttccaggccagcctaggattaatagtaagaccttaaataaacaaaaggtcactaggaaaacctaaataagttggtaatatctcatgtcaatattgttacagggcaatccttccatgttttttttttggggggggggttgttaggatctcacactgtagcccaggctggcctgaaattcactatgttgcccatgatggcctcaaactcttgcctcagtgtcctaggtgctaggattacagacatgagcaaccacaattagaattctgtatttttttttctgagacagggtttctctgtggctttggaggctgtctggaactagctcttgtagaccaggctggtctcgaactcacagagatctgcctgcctctgcctcccgagtgctgggattaaaggtatgtgccaccaccacccggcttatatgtaaatatacaaaattaaaataaaaatcaattaaaaatataatctgttcaggggtaaatggctaccacccacaaggccctggttcagtcctcagcactacaacactttttaaaaatagaaaaaaaaattcaagccataaaaattccaagggcttgagacctcctgtccttgagttgatgaagcccagcttcagaggtatggggctgtggtagggccactctctgggtactcagggatagggccgtggcgccatcagtcagctttcccagtttaatcttttgagagagtttctgctctcagctcccaaacctactgaccatgaccacagagcaagtaagtgcacagccaagccttttccatctcttccactccttcttggccttttactgaggatggtaaggtgttctttctccattctcactccaccagatggagctaagtctccattcctgggaagccccaggtggtttattaaccctctatcttgggtgtgtctgatgaccctgaggagtgagccaagtcccaggctggaggtgtcagccagtgactgatgtcttaaattaagtgggcagctgacccagtctggacccgttatcataatcccattacaaaaggcaaggcctgggctttggcacaggatttggtctgctgggaccctataagatccagggacttcagcccattccctatggagggacactattgtagctcagatacagcaaggagggcctaggccctcccccaaacgatgtgacagactttgaaggtccctggtgagggcctcattatccatggggaggagttggggcgtgggttgggggggttggtggggaacatgggaggatgggatggtgagggaatggggggcgatggatatgtaaatatgagtggtaattaaagaatttaaataaaaaaatacaactattaaaaaaaagatccagggacttccctctcacgtattgggccccttagaaccacttttgaaaaatgttgactgaccagggcatcatcttaaaattccatccctagagtggcagactcaagatttccctactacaaaaaccccaatttatccacagctggagccaaggtctcagccattcctgcccaggctctgcactgtgtttggcctgttctctcaacaatttacattgggttctctgtgtatatttattttgcagagaaggaacatgaggctcagaggtgaagcaacttgcttgtaagtgacagggcaaagatttgagggagggctaacttgttgtagagtaaccctggcagacattcagattaaaaagaagtattgggccgggcgttggtggcgcatgcctttaatcccagcactcaggaggcagaggcagaggatctctgtgagttcaagaccagcctggtctacaagagccagttccaggacagcctccaaagccacagcggaaaccctgtcttgaggaaaaaaaaaagtattggcagccaggtggtggtagtgcacacctttaatcccagtgctcaggaggcagaggctgaagcagatctctgtgagttcaaggacagcctggtctgcagggtgagttccaggacagctaaggctacacagagagaccctgtcttgaaaaaacaaagcaaaacaaaaagcagcattgccatctctgcaggagatgctgctgctgttggtgtactgtatactgtagaacagacacaggctcaggcctttgcatagattaattgaatacacataacaactccgtgcatataaagttataacttcttcataatggaaattggggctctaagagacccttgcaaggtcacatggaaagttagaaaatgactctcttctgccatttcttccccaaacctcctatcattggtttcctccctcctcctacactggctccccagcccctccctaatgctgtagctgagctgctcttccttgatctcaggtcctctggctgacccatgtccatagcccttcattcatattcttaccatgttttggagcctgatgttgggctaggctgtatggattagtgaaccctggagataattctacctctgggcatccttatcactttctgctgctggacaagaggagtgatggaggagcacatcactcaggccctctgaaatgtctgcatctttgtgagtagagcagtttagaggtaagagccagcaggatgtccatacctggcatggaggtcagatgcacagagtggggccaggattggcctctccaggctgcgtggttcccaggattggcctctcaagctggaagctgatatgagcagcagcaactgctggcattatctggcctctaagaatagcttgaggtaaagatcagaggctgtggccagggaaaaggacaggggcctctgtctccctgcccaacgctgctgcttggcatggaggctggagtcctccctctggctcactgtttgtctggggaggttttgaatggacacactcatccatctgtggactcccagaactcagacccaggttgtggctagagacagtgaacacacagtgcaggggctggtcctcacctagccatcctcccacattctaaggcctttattcacttagcaaacactttaaaacaggccttacatatgattaaaaatgcaaagggtattaaaaaggaaataaatcagtttctctccctgtccccacctactgcttccatcagtctcctgaggaactaatctacccccagataaactcatggacacacaagcctacctgacacacacagccctttctaaagtacattcttttttccagtactggggatggaacctagggcctgtgcatgctaagcagacgttctaccagcgagcatatccccagctcctctcacacttttcctaatgctctgtcttagtaacaaattgagtctccactagtaataagtgctagtcttagtgcttcagatgttccaattccacctttatgttcaggatctatgtcgtagctattctgctcactgttacaggcttaagtgacttctcaagatgttatggctggtaattgacagagacaggattcttcctcttaagtttgagtcatatccctatgatacaagccttctctcttcctaaaggccaaggtaagaaatgtgtagtgaacatttaccaagcacaaggctaattgggatacagtagagcataaaaaagacaggtctctgctctcttggatctggcaccccagcactcacaagtgcctgtcagcgaaggtggcagaaaggggaacccacatgtcctacatcgtgttcaaggctgctgttcagacatatccttgttcctttacccacgagtcctccagctccccagtcttggagccaagaacccttggagcttaagtgaaagttgaaatagggaagatggggtccagacagaggtagcagcctatgaggtcaccatggagccctggtgagcctcatctcattcctctgggatccacttcagcaggcctggtgggggtgtctataatccagggaccagccattgtttgaagttggggacaattgaagggcgagagagctatagatagatccacagctgctgtcacctgtcccagcctgggcctagggcccaggcattgtctacattgagggcctctgggggtgggtgatggaacaggcccagctgagccttagagagactgagtcaaagtccaggagggagaaatgctaagtctcagagggaaaaagaccaagtcccttgaaagatttaaggattcctacccagtgtccaaaacagccagattggtgttggggccagagagagaaagcatgctatggagatactgcggagctaaggcaaaggttgaacttacatatgagcagatcagaacccgagcagagctagtgatgggagctagagaccctcagcaccacacagatcttctgggacgcctgcacatgtacttttttatatctttttttacttgggcgactacatcccagagttgtttatggaacaatttgaaggatcttcatgaatgctctgagagtccccagggtctttagaagcttgaagatatgctgctgggtgatagcttcacaaagacctgtgtacccctttgtgcctcagtttctatgacttcaatgtgttcatttgtacaaccattaaagggtccttcattctctggtgctggcaggacattatccctgtttcagatgaggccacagtccctgtacttagtcctttatggggatgggggacagctggttgcccacttcctccccccagtaacctttcagacataaatccatgctaaggcatctctctctggataaacagccttgatgccttttggctgccctcatcctattttctgcttggagcatcagagctggggcccactcaagccctctgcacctgcccagggccccatgaggaggacaaacctgggacaagcaggggccaaccacccccagagtgccaggatggcgggcccctcttggggcctcaccaccttgcctgtggaccattatggcagcctcctcctgagtgagccttcctgccaccggtgggtctcgccccttcaatccgtcctccacaccagctgccacagggatctgatgaacacataaatctggctgcactgtcagatctccttgctcagggctctttgatgaagaaataaataaaaacgcctttgatggtgccccagctcacacaggggaaagctctaaatcctgctcttgcttttgaagttcttcacagccctagcccaatgaccaggtccagccttgccccgcgttatgccctgaggcctagcctcagtcatgcagttgctcaggacggatcttcattctcttccctccagcactgtgggctcaggacacctgtctcatcgtctcttccctgcctttagcaccttggcccatctgcttctacctgggtgacctcagcaaactcaactgttccccgatgcagctcttaaccctcccagtctattctcaatgtggcagccagaatggccactcttaaactttaggccatccttgccctaaaaggttcctattgttcttgcaatcaagtgtgtgtcccaagtgttttgagattctgaacaatcttgcctattttctaccccctgttattcactagtaaaactcttctcctaaaacatatactttttaaaaaccacactcagtcttgtggggtataccgggggcagagacaatttggagctaggttctaaaatcctggagtctagtctcctgaagctggaccagacttcagccattgcccactccaaagcattgaaccctctgtagctactacaggcacactttcttccgaggctggctcttcagtcacaggctgactctgagtttgtttgtttgctttaattttatgtgtattggtgttttgcctttatgtatttctatgtgaagatgccaggtatcctggaactggagttacagaccattgtgaactgccatgtgggtgctgggaattgaaccagcatcttctggaagagcagccagtgctcttaaccactgaaccatctctccagccctggctctgagcttcagaacccacctgtgtatacaactttgcttcctgtcattgtcttgcccactggtctactttccccatctctctccccatcccagactttccagagaaatgttctaccatgaagtcatggctccaatcactgcagattcgcctttgaggctgcccaagtcccataaactccctttgctcctgacagcatagacatatttgaaattatcacctcaagcccttgcaaattgcaggcttccttgaatctctcagaacatgggttctttgttgctttgctattctgacctggatactcaaccttagcaggaagatgtgccccgagtggtggaagtgaacctagcaggacatttctaggcctgtattctaggtttgtttctaagcaattgaatgtacattgggcagtaagtctagaattttacccacattgtatctttgcatagactacaattatcgtaaagttctgattttttaaaagttaattttgttactcctgggcaaaaagccctgcatgctgagtacctttgagcagtgaaaagttgtatctactctctatactgtgtgtgtatgtgagtgtgtgagcaagtgtgtgagtgtgtgtgtatgtgtgtgagtgtatgagtgagagtgtatgtatgtgtgagtatatgtgagtgtatgtgtttgtgagagagtgtgtgagagtatgtgtgtttgagtgtatgtgtgtgagaaagtgtgtgtgagagagagtgtgtgtgtgtgtatgtgtgagagtgtgaatgtgtgtgagtgtgtgtgtgtgtgtgtgtgtgggtgtgtgtgtgtgtgtgtgagtgcacccacccatccatgtgggtgcaggacatcaggtctcctgcttcattacttgtgaccttactcttttgaggcagggtctctcactgaacctgcagatggccagcaagccccagctatcttcctgtttcctccccacagtgccagggtgacagatgtgcacttggccatgcccagttttgtgcccatcacaaacccatccctttacagggatgctgggatctgaactcagatcctcagactggagcagcaagtgctcttacccactgaactatctgtctgttccctactctccacacttctacaagttgctccaactcggctcccagcttctgaccttgtgcagatatgaaaactctatcacctaaactatcacgtttaattcatttgcctggtagctatctactgaattctgtactggacaggcattctgaaaggtgctgggaatgcagaccagactcctgtccccagagtttttagtggtgggaggcaaccaacctccacaaagagtgaaaatgaccttattctcacacacatgtctagaggatgaaggactagtgatataatagcccagacataaaaattctgaaaataggctgagtggtggcgcatgcctttaatcccggcactcaggaggcagaggcaggtggatatctgagtttgaggccagcttggtctacagggtgagtttcaggacagcagagctacatagagaaaccctgtcttggaaaaccaaaataaaccaaaagacaaaaatgctgaaaataggtaaaactaataagtgatgttagagtcaagattgtattacctcagaggagagtttacacttttgtcagttattaccaaatgtgtcagtgaagtttttattttaaggcttttacattttgtgtatatgtgtgtgtaagagtatatttcagtgtgcgcacgcgcgcgcgcacacacacacacacacacacacacacgtgcgtgcgcgcatgcttgatttgattcacaaaggagacacaactgtgcaactaccacttagctcagtgtctggagcacttcttacattccagaagtctctcctgtgccctcaatcctcagaagaccagcctccacttctgtccccatacttagttttacctgctctgatagcataagtggtgccagtgtataaaattacttttgtatattttgtttggcacagctacatatccggaatgggactgaagggcctgaaagtttcctgacatattctagagttgtagcagatggactgagttgtaagcaccccactcctcatgagagtgaggtacaagaaactggctttctctaagtcacaaatgtcagaatatggaggcacttctaactagtctaattttcttcctcctttttactgtgtggtaccagctctggttctgcctgtcttcctccctccctccctccctccctcacatatccccagccccctttctaccttaatattttttagtttgagatggggttttgctaaattacctagactagctttgaacttggcttcttcctgtctcagcttcctgagtgtcccggtctcaaactcgggacaaatggcaaactgaggtgcctcatcttagcaatttgtcttgagtttctttgagacctaacactaagtaccaggagctacaagtgtctaccaggcccacgtttgggttttcttcatgttggatttccttttggagacagaggccaggatggaggctaaggaggaagaggaggaggaggaggaggaggaggaggaagaggaggagggtgagtggtgtcccggagctgtctctgttgctgacctttgagaggtggttagtgtttttttctttctttctccagacttcctagtgcaggaagagaactgaaataggtggtttcagtgaacgctctatggcacccttccccgtttttttgttttgttttgttttgttttgttttgttttttaaactctgtttctggaagtgcaggtcttttttgcatgtatgagacttcctgtgactcagtttccactcttgagtgccttacagccttgtccctgtccctgtcactctctgaatcccagattcctgactgagtggactgtctctctctgcctttgtgatcccctgacaatgggaggtaaaaatagcccaggggctgagctacaggagataaaagggaatttgccttttgtgtcctgtggccaggctggggggggctgtgacacgtggagattgctgacatagttctcctttgctgaccttgacagtggcaataaaaggggtagcacagcttcctgccctcacagtggtgccaaggtgggtgatcagggctggggggtaatcggagctgggggtgtgatcagggctggggaagtgatcagggctgggggagtgatcagggctagggcaggtgatcagagctggggtgggtgatcagagctggggatcgtgatccagggctaggtttggtgctggagggaaggcaggagagagcccattgatgggcccaggtcctcagtacctatagcaaaggatgctcttatgcttggaggtgtgcattttcatgctcacccggggagacccactatcaaaccttgtgagttagagggtcatactccagtatggaacccggcccctgagtttcctgtcattgctatcttccagtgcctgctgcctagagccaccttgaatcgccgcccagattttcaggcctcctcctccttctcctcctccacctctcaccatcatgatggatgtgagtgaacttggagaatcagccttctatctacgccagggctaccaggaattgatgaaggtgcacactgtcccatgggacggtaagtgagagcagaggggagcacagccatggagaagcccaatggtctcagactaggagtggagagggctgccattctgcttgttactacaggggcactatggcccagcacctgggatgttccctcagtttctgggtgtgagaggctaaaaatcacagaaaccatgtgaatatgattgtgtggctgcaagcaaggcttggtttgtccctctgtaaaatgggataatgtcatcttgctcttgatgtctccatgaagactcaggctggactggggcctctgaaatgagactgatgtgtgcaggtggcctccatgttcacaaaacctgtgctggacttatttttagtgttttccatggagcccaagcctctgtttattagggacaggaataaagactactatttatgacttgattggctcatagtacaataataacataggcagtgtgtgtctagggcttactgtgtgccaggcctggagctgatgactttctgtgcatcttctcaataatctggtaggtgggaaccaaagcagagccagatcagtggtgtgcaacatctggagctgtacatagcaccatgttcaagaggtctggtgcttagctgggcatggtggcatacactcagcactcaggggccagaggtaggcagatcttggtgaattggaggccagccagagctgcatagtgagaatctgcctcaaaagagaagtgtctcaagcttgatttgacattcttctcgtcatcttaattgttttcctttgtttaaaattttagcatgcagagttgaggatttccttgaggtgtttaaactttttaaatgcatttaaaaaaacacaaaacaaacaaacaaaaaaaacaagggagacttgaatgaatagttctgaccaaggcacaaggttaccaaccgggagggcagggaccagaatttgctgtctgtatgagttcacattttttaccatcataaaagtctgggctctcagaagctctagggtgagctgaccagtcaggaaaaaggagatccccaggtgttcagtgaaatggggaaggtacaagacacctgagagctaggagcctgatattgatggggtcgtccacctgggacatcaggaggcctcatggcctttgtgtttaaacaggcccagagagaatgaggtttcccaggtggcagggagctgaatccagacatgcactgtagactcctttcccaatcagctcatttgagacctttagggaccttcccagctctgtccagggtttgaatgagtcctcactggaactcccagcccctggcagaaggactagatggagaactgtggggagggcactgctttatgcccacagtataggaactcccctggacacttagagcccctctcaaagtctgatctttctgcaacccaggcaagaaacgggtctgggtgcctgatgaacaggacgcctacgttgaggccgaggtcaagactgaggctactggaggcaaagttaccgtggagaccaaagaccagaaggttgagctccccctcccttgagattggctcgccagggtgcatcccctgacccgctggatcccgcagagtgaatgaagctggggtggggcatggtagcgtgtgggtaggagagagaagaaaagacagttggcccacctctagccctcatttcatgacacgtctccttggaaggtgctgacggtgcgcgaaacagagatgcaacccatgaacccaccccgcttcgacttactggaggacatggccatgatgacacacctcaacgaggctgcagtactgcacaatctacgccagcgatatgctcgctggatgatctatgtgagttcagggcagcggtgggtggggccactaacggggctgacctaatatggggcggggttaagggaagaagcggggctccgaaggaatggggtcaggcaagctgggttagaacagagctgcagggggactctggggcggaaggagcagaactgtatagtggcagaagagaaggctagagggagcagccgcaggtgaatgagaggaccacctagaacattgatttggtgatgtctagggtcttggagtcagagcaaggccacggggtagggcctgagatatggctgcctacttggcaccattgaagattcagcagaggactgtgggggccgttgttacatgggattcaagctgagacaggaggatggctgtgcatggcttctcaggaggcttcttgaagattgcaggtgggcctgggaatgggaacttggacatcttacttccctccccctaaaattccatctgtgaactctttctccttagacatactcgggcctcttctgtgtcaccattaacccctacaaatggctcccagtctacacagccgctgtggtggctgcctacaagggcaggcggcgctctgaggccccgcctcatatctatgcagtggcggacaatgcctacaacgacatgctgcgcagtaagagctacctccttcgccacccctcagctccggggggcctctggctaggactccccttcccttccatctagcactgccctcctgtggcacgaccctagctactcgacctcttcagtctggaagtccgccttggtctttcccactgggtctttgccacaactgacccagaaagtccacctatggttagtccctcaccctggctgacgtgtgtactctctcccctttcccctagaccgagagaaccagtccatgttgatcacgtgagtggggctctgggcatgaagtggaaagggctggccatttgctggtggtgatgaggcagcaggaggagggggtggtggtgaatcaatgttatttctcaagattggattcaaagttcttagggcagggcctttacctcctggagccagtgtcctccacttcccatttatgggtggtgggcagaaagcaggtaattaaacacaggagtggccccaagctccttgctgtcttcccagagctgggatctcccacctggattctctggagggtctatataggcctcttccctggtcttcaaagcatcttctcatctctacctcagccctcatccttcctttgccttcatgggaaagagatccatttctgatgtatcgggttcatatccggtcaggccaatacatgtaaatacacacacacacacacacacacacacacacacacacacacacacacacctttagcctggttattacagtcactctgaaaccagacagagctggattcaggcactcacacttgcatttcttgctgtgtgcctttgggactctgagcctcaccaataagaacagcacaacctaagccgccacacaaaattaccaacagtcagtatgtttaaatgtgaaccttgcacagagcaggggcaggccgggaaatttctgaggtccacttccttattcataaaatgatcacagtctgccctatggggtcttctgatggaggtgggtaccgattggcaccaggaattaagctcgtggtgcattggcaccatcatctcagagtgtctgtacctgggagtttgcatctggggatactgagttgggaacagagatggggttgaggtttgggggctggaggaattagaacaatgggcattggtgactcatgtttgtgttgtccaagcggagagtcgggggccggtaagacggttaacaccaagcgggtcattcagtactttgccatcgtcgcagccctgggagacgggccgggcaagaaggcagtaagacttgcccacttgggcaccaatccccactgcttctcactggttttgctttctttctttctttttttctttttttctttttaaaattgcaactccccagagtccccagccctgcctgagcctcctaccttggtaagagactctggcctgagcaaggcttgaccagaaaacctgtggccacctccgtcactgtattaggcctgagccaggcctgctgcagccgtatccgccctccaccgcacagatgggagccgcatcgctgctcccagatgttttgtgtgtgtgtgacttttaccttgaagtgactgttttctcgggtcgtatgaatcaaagtcactgttacctgctgcaaaggagaggagcaggtttatccacagatgtcagttacccagagctggggcactgggagctcttgacaatagcacagcctgtggtttggttaagatgttctgaaacttcttaaaacagtggagacatgggggttttgttggttttaagtaaactagtctatctctggcccctgggccagctgctgagagctctgtggcttccgctgacccccatgcgcctacactgaagtgagctgtcttctttctgggccccaggtttcctctgcacaacccacactcctggtcctgttgagccttgctttattctggggcagttttctttttcttcttgctgtgttttctttcttcttttgttttttatccccaccccctttaccccctttcctcatttgattatcttggtttttggactttgttttggtttttggttgcagccatttttttttttttttctgtccctcacccctttctcccctttcctcatttgattgtcttggtttttggactttgttttggtttttggttgcagccattgttgttttgtttttgttgttggctttttttatactcttcccttcctttcccaccatgttttcccagccctaaaaggtttttgaggatactgcagaaaagtgagggtgaccccgtaataggaaagatgacagagactaaagctgaccggaacacagctggaaggtctagggccaggggcagctcagagaggtgcagaggccacccatgggatttggtgacttaaaacctgtactaacctctccccttgagttagatttagctaagctggctagaaagagttctgaacagaaacagtggtttgagctgggcagggagatcaggagttatttcctccatacttccagtagtgtgcctagcgcgtttttaaatcttgggctctctggagatcaataagtgaatgagtgaccacaaagtccctggcaacatgtatactgtccccagatctgttcctctttgtcttctaaggctcttggcgttgggtggggtggaggtggagaggcggagaacagtgaaacatgaaaatggaaggaagaatgaagctaggaggggaggagggagtatagactcagaccctgtgtccctctgagtgagacacagaagggcatcacaggaggcaggatgcttgaggtgacccctcccccaggacatgggctgatcaattccttgatctgatggagctaatcagtcacagctagcagggccacatcgaatatccgtctacacaatgctaacaacacagacagcacagtacagaaaatatgcagaagggctgccagggaggttaggataggaaggctcagggtcctaggatgtccctgttagctcagagatcagggatgtcttctcagaggaggaggggctttggcaggcctccaagggagagaagacactatccacatccctgtgtgaatgtggtcaatgaagagattcctgagatggagagacaggtttgaccttagtacacaggaggccctcgtgccacgggcctcaaggtctcaagcctatgactgtgcttgcttccccatctagcatctctcagctaatggccacaggaaagctaggtgtacagacaggggaggacagaacattacgtttaacattactaaatatttgggcgactaacaacactgtcccactgactactgtcccaatgtcccacccttttcggagagacctcacatcctctgacattttccttctccctccagcaatttctggcaacaaagactggggtaagtacagggccagtggtgggtaagataacatctatggggtcccagggtgcccacttcttacaaccaaagattccatgggctgccctgacccctcattcctgctgccaccaggggaccctcgaggatcaaatcatcgaggctaaccctgccatggaggcttttggcaatgccaagactctgaggaatgacaactcatcccgctttgtgagtgggcacagtgggggattttgtggctggggtggaaaagggtcactagccaggagggccctggtggtgggaaccaacaggactgagggtggcatgatccgtctgctgcagggcaagttcattcgtatccactttggtccctcagggaagctggcctctgcggacattgacagctgtgagtctgggaaagggcagggcaggtgtgggaggagggacagaggctgaactgaacaaatcctttggcttccctctgctctggccatttctttccaccccaaccagttcctacttgcatccttctcacccatcatatcggcctcctggtctctactctcctgccttgactgctagtcagtctatggtccaaagttgatcatgccctgtccctgcttcaaaaccttctctagggagctagggggaggactcatgggtaaaatattgctgtgcaagtacaagaaccagagttcagatcccagcacccatgcaaatgctgagtgggtgtggtagcctacttgaaatcccagcccttgggaggcagaggcaagaagtcttagagcaagttggatcataagggcttcatcagcgagctctgggttcaattgagagacttctgcttcaatgtctgaggttgaaagtgatggaaccggacaccagaaactcactcagaggcagacacaagtcccatacagtgacttcccagggtgtgctggcctgtgcacagactcaggcacctccacacattgcctgtccttcgaggctgctgcctctcatccctgcagtgtctttgctcaggggagggaaggagatagcaggccggcactccttctctgcagatctcctggaaaagtctcgagtgatcttccagctgcccggtgagcgtggttaccacgtctactaccagatcctctcggggaagaagccagagctgcagggtgaggctcagaatggagaataaaaccatcaggccaggccctgggtggctattcaccctctcagcagagatgtgggtaacctccactcttctgggggctcacagcctgtctgtctgtacccctccctactccttcctgctgcttcttattaccatggagccctctttgtaaaaatgtttttggtggtagttgttgaggggtagtgggggtagtggtagtgtgggggtgggtgacggtgtgcctgtggtaggaaacaggcctcttaccgccattgtcctgccaagattgcagctgctcctgccatcctgagattagaacccctacccagcaccaagggaacccagtggtagtctatgtacactctcacctttgcaagccctttgaaggcaaagtctggtcctccctttgtcccagtatccaactcaggatctgggctggagggatgactgtgagcagcggtcagaggatgagtgagactcatggactgaggtccagtctccagaggactgtaaagagacacccgccagacatgcacatgtgctttagaaatgaaaacgggctgaggggtggcacacaactttaatcccagcacccaggaagcagaggtagatggatctctgtgagtttgaagctagcctcatctatatagtaagttctagtccagccagggatatatagagaaaaaccttatctcaacaaaataaaataaatatctaaataaataaaataagaattttggtttttttgtttgtttgtttgttttcaagacagggtttctctgtgtagctttttgctttgaagcctgtcctagaactcgctttgtagaccaggctggcttccaactcactgagatccacctgcctctgcctcccaagtgcttggattaaagcagcagccagccatgcctgtattcctctactcagaagctcttaagttcagggccagcttgggctacatagaccctgtctcaaaagactaaacaaataaacataagtaaaataaattgaaagtcacatatatggataatagggaacagaaactcaggttatggagaagccctgggaaggaatctagacttgctgacagagatacccccagggcctcaagatggcaaggagagggaaggcagcctgtggactcagcctgactcaccctttggggcatcttgtccacagacatgctgcttctgtctatgaacccctatgactaccacttctgcagccagggggtcaccaccgtggataacatggatgacggggaggaacttattgccacagatgtatgctcggtgggggagggggagtgggagtgggaggtggtgccaagctgggttcccatggtgtgcgtgtgtgtgcgcatgtgtgcctgtgtgtgtgaacatgcgcactgggtgtgtgtgtgtgtgcatgtgtgcctgtgtgtgtgaacatgcgcactgggtgtgcgtgtgtgtgcatgggtgcctgtgtgtgtgaacacgtgcactgggtagagaccaggaaatatgactggtgtggcagtgcctggctagactctcaaggacccgtccttctctgcacctgctttgttgccccgcctcagcatgcgatggacatcctgggcttcagtgtggatgagaagggtgcctgctataagatcgtgggcgccctcctgcactttggcaacatgaagttcaaacagaagcagagggaggagcaggctgaagcagacggcactgagagtgagggcctctaattccaggctgacctggcctcttccctggataccttgtcctgtacatggtcattaatccttatccgtaacctctgacctctgaactctagaccctcctgagggtgacaattttttatgcagtccttgactcctcccatccttcctcttctaatcccactctgtgacaacagactcccccccccccccccccccccccccccccacccccccactctccccccccccctaaccctctaaccctacccaagctgtgctccctccaggtgctgacaaggctgcctacctgatgggggtcagcagtggagacctcctcaaaggtcttctgcacccccgggttcgtgtgggaaacgagtatgtgaccaagggccagagtgtggagcaggtgagatgcctgcagactaaagctcagccagggacagctgaggcagggtccctttcttgccaggtcccaatcctgccttccttcatccacaggtggtattcgctgtgggggccctggccaaggctacctatgaccggctgttccggtggctggtgtctcggatcaatcagaccctggacacaaagctgccccggcagttcttcattggggtcctggacatcgctggctttgagatctttgaggtgagaacagctctcaaccacaggcattgttctgaggcaggggttgatgggtggatatgggggaccacatccctgcttccccatgggcctggtccccgtctaccaggaacctgctgactgtggcactgcccctggtagttcaacagctttgagcagctgtgcattaacttcaccaacgagaagctacaacagttcttcaaccagcacatgtttgtgctggagcaggaggagtacaagcgggagggcattgactgggtcttcatcgacttcggccttgacctgcagccttgtatcgacctcatcgagaaggtcagacctagggggggacattgtcagaagtgctcaagtgtgtgtgtgcccagaggcctggtgcgtgtcagctgtgtattgatgtgtggttgtggtgaagcatgtgtgtgtgtgtgtgaatgtggttgcatggctgtgcacacaggtgtaaatgggaacgtgtgggtataggtgaatagtgtcataagtgacgtaagaatgctatgcagccattgtgggcagctctgccattcaccaggcccggtgcagaactcatctgagcagtctcttatgtttactggattggaacacattgcatatgcttccccactgcacaaagaagggaaaagtgaattgacatcgttggaaataaaggggggagggattccctttgagcctcccacagcctgtgcttgtgtgtgtgtgtgtgtgtttgtgtgtgtgtgtgggtgtttgtgtgtgtgagtggggggggcagaggacagcactgtgtgtgtgtgtgtgagtgggggggtcagaggacagctcagtgtgtatgtacttcatggacacagtcccagtgtgtagtatgtttatggacacagtcccagtgggtcgtatgtttttcctctgaacacacattttccctgctgtgaagaagccagaataggccttgcggcaggtgactctgagtctctggctgttgggcatttaggttggcttttttttttgtctattaaattagtattgaagtgaaatcattttcccatttgaggcaattcatagctgcatgtaacttcagtcccaagggatccaattccttctggcctccatggacacataaactcatgcaggcacacacacatatacacacatatacatacaaataaataaacacttatttttaaaaatatagacttagtaaaatgcaggatccctaattttgttgaatgtggggaccaaaatgcagttagttggccttaagaaacaaaacccaaaaacctagagtgttcatgtgagccatggacattagtcaatagagcgcagagatgccaggctggtctgcacgcacaggcaaagaaagagactgaaagtcaagccacaaactcttctctcctagaaggtgggctcctggttatagagctcgtccctggccctcctgcagatggctgggttatggatttgaaacagctcccagagggagttagtctggagagcgagagtctaagaggccagtcagcatgttctagcccttcaatcttgatccctgtccccagcctctgggcattctgtccatcctggaggaggagtgcatgttccccaaagcttcagatgcaagcttcagggccaagctctatgacaaccactctgggaagtcacctaacttccagcagcctcgtccagacaagaaacgcaagtaccaggctcacttcgaggtggtccactatgcaggcgtggtaggtgcccccctggaactctactctcaaccactgtcctctcccttctcggggtcaccatcttgggtcaacacttgtctctgtaggtaccttatagcatcgtgggctggctagagaaaaacaaggacccccttaatgagactgtggtccccatcttccaaaagtcacagaacaggctcttggccaccctctatgagaactatgcaggctcttgctccagtgagtactgagggacaaggtggtcattcccatggatccagagtgacattccctggcatgatcagttctcatatctctactagctgaaccccccaagtctggggtgaaagagaagcgtaagaaggcagcatcgtttcagacggtgtctcagcttcacaaggtgaggtccagacagggctccagcagccctggccctctgcagcctgcaatgccctccgctttctgccgcatccctgtgtcttgggtgggcagctgttaagacttgcagtgatgtttagctcctctctatgtgaacatcacagcaagtctgtgctgctgcctgcccccgtgctgcctgcgcagggctcgggggagagggaagccgtgggagtgagccctgggaggggggacgtgaagactttggtggaggatggggtgtcatagggagccagagaaaaagagcaggtgcaggtgcatttgggcccctctgctcagtccccactggtcccatccactgcagtatccaattccggttctctgcccttcccgtgccttctccactcccaggagaacctcaacaagctgatgaccaacctgcgggccacacagccccacttcgtccgttgcattgtccccaacgagaacaagactccaggtggtgtccctgggctggtcaggattggggaactggaaatgctcttaccttgtagggtctgctcattcccaaagtaaggcctgggtagggacctaaaggcatgtccttggatttctaacctcctcctttcactccaccacaatctaggggtcatggattccttcttggtgctacaccagctccgctgcaatggggtcctggagggcatccggatctgtcgccaaggattccccaacaggctgctgtatgctgacttcaggcagcggtgggtactggcttcttcagcgctgccatagcctccttctcctgcttttagattaggtggagcctgaggggtggaagggacaagttagagcccaagggacaaagagaggttctagtcccggaggagaaggctccatcttggcgggggggggggggggggagggtaaggagagccgtgaatacgctgtggcaaatgtggagagggaggctgcaggcttgccaattacgtggatacagagtaagaaaggatgagctacggtgactcccgggtttagacctaagctgttgcagagtgtatctactgagcaatgtggcaggatgtttagattgggtgcatacagggtttgagcatgcccagttagaaatatctccagcagatgtcctggaagaggcgaggatgggattgatttattctggagctcaagtgaggagccaaagaggacacagatttgggaactgaatataggtttgtgtggattggaccccagctaatgcctcacaggttgccagtggtctgtcaatgtcatcagctcccttcccactttccttggtaggttctgtttattaagctacaagaagtgtcctcagttgcttccctttctacaagtaacagggatcatttaccctgccctgtataaattagatgtctatacaaatactatacacacagtctgtaagtttggtttacatgtcattatcagtcttggacatggatccctatctccaaagactccaacatgagtctgtatcatcacccatttgttgtttgaaagcaggacattactgtgtagtctgggctagcctcaaactttcaatactcctgggcatggtgtctcacacctataatcccagcaataggcagctgggcaggaggatcaccaagggtttgaggccagcctggtctacatagtgagttccaggacagcctaggctacagatgagacatttcaaacacaaaattaaaaccaactcttgggacttggcagatggctcgctaaaaggcttgccttgaagcatgaagacctgagaacctagaacccacatagaaaatgttgggaggctggtgcacactcattatcccggtgccaaggaggcaggagttctgagaccccaggccacccagtatagtctaacagatgagatccaggcactgagaggcctgtctcaaaggaggtggattgcattcagggtagccctgagcctgtggtctggcctccatgtgtctgtgtacctgtgcctgtgcacgtacatttaaaaccagacctgtgctgaagagatgactcaggggttaagagcatctgctgctcttacagaggacctgggttcagttgttagcagccacgtggcgacttaaaaccatacaaccagctgtgtgggactccagctccaggggctttggcgccctcctctggtacatacatgtaggcaaaacactcacacacagacaattaaataacaaccctcaatccttctgcctcagcctctgaatgctgccagtacaggcatgtgtcatcaaccggaatacatcactattgtttttctattgcctgtaaaacatacagtggtccaatgaccaatgcatcttatttagtgagttcaccctagtgaaggggtctggcctgtctctgggaatttcccttcacagtgtgattatatgcccatctaagtggaaatgctaggaatccttgctccttttgaatagaattctctcttaaatttgtgatatggtgtagcatctatgttttattttgtttttgcctttaagaaattataaaagttgaacatgcctttataaaaaccacgtccctttacaaactcactaaagtgcacttaagccaccaagtccgcttttgaaacagggtcaggtcaggtaacaggctggcctcaaggatcttcctacctctgcctcccaagtgctaggattctgggtgtacgctgtgcacctggccctgtgctgaagtctgtgtagcatgtgctgcatccctcagtatggccatacttccctctgccatcctgtttagcgtatgtcccttaggaaccccacctctgagaggtcaggcaaatacaattctcttgccacagctcctggcgtcccattcattgtcaatggcctgtgctctgtcttgtccatgccagcttctccctgatctcctaggtaccggatcctgaaccccagtgccatcccagatgacacctttgtggacagcaggaaggccacagagaagttgcttggctcccttgacatcgaccacactcagtatcagtttggccacaccaaggttagggtgcactggagttagggctgaacctgggtgcctctgctcacactggacaggggtcccacttggctacaccctgcccttaggtgttcttcaaggctggacttctaggcatcttggaagagctccgggaccagcgcctggctaaggtgctgacactgctgcaggcgcggagtcgaggccgcctcatgcgcctggaataccagcgcatgctaggaggaaggtagcatgggatgggggatgggcaggagggatggggacagggtggcacaggggggggcggggtaggtgtgataaccgtcccaaggctcacactctcaccctgcctcactgcctaggttgtcccccagggtggattcggatgaggttctgtgtcacatcatcccaacctgtttttataccttaaaaacaggatgagagccagagagatggctcagtaggtaaaggcacctactgccaagcctgataacttaagttcaattcccaggacccacatggtggaaagagagaactgacctctacatgtgctctgatctccatgcatgtgctgtggagcatgtgtgcacacacatggctttttgtgtattcagaatgtggcctggagggtaacggcattcagtgcttcccagactttgaaccatgtatcttatctatcttatttatggttaaagtgaggtagccctctcgggtgggtaccactcagcagagaagtcaagcagtctgatcacagggcctggcagcttagctgtctttagacacctgcagaggccacctgggcattcggaggttatggactttgccttggaagtatatctgtgggttagagagagagagagagagagaggacatggcaccttgaaggggcagaaccagctgcctcataggagctgtccttccctagggatgctctgtttaccatccagtggaacatccgggccttcaatgctgtcaagaactggtcctggatgaagctcttcttcaagatgaagccacttctgcgctcagcacaggcagaagaggagctggcagcacttcgagcagagctgcgggggctgcgaggggccctggctgctgctgaggccaagcggcaggaactggaggagacgcatgtcagtgtcactcaggagaagaacgacctggccctgcagctgcaggcagtgagtgagacaagggctctgatgaaaatctctaaccagatgtggccagggcagctctggagggttctgagtactttgatcttctgtgttgtcttcctactctggaagtaccaggagatgaggcctggagactcagtgcccaccattccctgtaggccttgactgtccacatgtcctaaggctaaagccgcaggagagccccagctccaccttccccaatgtccctgaaatagacccttgttcccctttctggttcagggacacaggaatctctgaggcaggtaacagggttctacctagagggcaggtgtcaaagtctggaaactcctcagcataggttttgagagtcacttggatgccagccccaggctgatgctggagatgctgatgctggggacggcacagccatgatggttataaaactccccttctagtataggaggctatgcaacaggcagtgtagaagtatgaagaaccctgtctcctccttggatggcctttggtgctgctccgtggtgggcgaggcctggcctgcacccactcacactgccctcagagggtggcagctccgaacagtcgagtgcacagtagggcttctctctgagagctcttaggccctctgggttgcctgcattgtggctaacattaattcttaacagtgccatttctgtcccacgtccaatgccctggagaggcccctgcaatctacagagcccctatagtttccagggccgggcagagtgtgggtgcttcaaatcctcacctatcaaactgaattgctaacatttgcctcaccggagttgcctttgcaaggacaaatggcctttctttctcagggctggtgtccctctttaatctggctcccccacccccatctcctcaggagcaggacaacctagcagacgctgaggagcgctgccatttgctgatcaagtccaaggtgcagcttgaggcgaaggtgaaggagctgaatgagcgcctggaagatgaggaggaagtgaatgctgaccttgccgcccgaaggcgcaagctggaggatgaatgcacagagctcaagaaagacattgatgacctggagctgacactggccaaggctgagaaggagaaacaagccactgagaataaggtgtgggaagggccaagctgggggccagtttaggtgttaggcagctgcagggtcccctgggcccctgctgtgtagcctgaaacaggtcactgccccctgtgggcctcagtgctatcatcggtcaagtccggtaccagcactttatctcactagggtgatgaggatttggtgtgtaactagtctttgctaagtatacactacagggccttgcatacagtaggtgcttagaaaatgtcgcaattatcatctgtcctggactgcgagctcgctggagggggcaacttgtccgaactgcaaatccgtctatcatagagacctcatagtgcctatggttgccgatgatgtattgactctgtcatacgggagaggaaagcaaggctgttcaggttctcacaggggctaaagatacagccaggagtagtaaagagctcagtacctgttgatattgcaaatggctgccatccactggtctcttactccgggccagacacagtgctcggctatgagcctttaccagtgaatccttctacatagctcgaggagcatgaaacccttgggcaggaatggtggaggctcagtgcagtggcctgcctgcatcctgcagctggtaggggtggctgctcagacagcctgtggggaggactgtccctactgtgactcaattgggctttggcacaggtaaagaacctgacagaggaaatggccacactggatgaatccgtggtccggctaaccaaggagaagaaggcattgcaggaggctcaccagcaggctctcggtgacctgcaggcagaggaggaccgcgtgagtgcactggccaaggccaagatccggctggagcagcaagtagaagatgtgagctgcgggctacatgggggccgtcagggtggcgaagtccccagcccgtgggaagctgagccccactctaccccacagctggagtgttccttggagcaagagaagaagctacgaatggacacggaacgtgccaagcgcaaactcgaaggagacctgaagctgacacaggagacggtgactgacactacccaggacaagcaccagctggaggaaaagttgaagaagtaggtggggcttggtgggtctctgagctcaatgggctcttcttcccttctgaattctcccagccctgctgtgggggagggtaccagggcaggtgtcatgtcctgccctctgaaccagggctgaggacagcagacgcatgcacaggattgaggctccttagggcctcagggacggaggcggacgggggggactgcagttgggaccagggctggctcatcccaccatgtactcccaggaaggattcagagctgagtcagctgaacctgcgggtggaggatgagcagctcctgggggtccagctgcagaagaagatcaaggagctacaggtgtgcatggcagcagcggggaatgcgctgggtagacccggcccggggcagaggctcatggagttggtaccatctacccaggcgcgggcagaggagctggaggaggagctggaggctgagcgagcagcccgggcccgagtggagaagcagcgggcagaggcagcccgagagctggaggagctcagtgagaggctggaagaggctggtggagcctcagccgggcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagcgggggggcggcagccgggggggtggggcggcgcggggggggggggagggggggtggggggcccccggcggggcggcgtgagggctgccgcaagcgtgaggctgagctgggccggctgcggagggagctggaggaggcagtcctgagacacgaggccaccgtggccgcgctgcgccgcaagcaggcagagggtgctgcggagctgagtgagcaggtggacagcctgcagaggatccggcagaaactggaaaaggaaaagagtgagctacgcatggaagtggacgatctgggggccagcgtggagacgctggcacgtggcaaggtcagcctccttcctgcctctaaaccacttctgacgccacagctgacccagccctgtctgatggccacttgatgccaatactccacagcagcaccaacccctgggccccagctgcttacttaacctggcatctaacccccagctcctgccaggcctgacttctaaccctgactgctcaacttcagtccctgcctccaggttgttctgattcgcaccggaacttcagacctcccacccaatagaagtgtgatgcagctgtgactcccgagttcacacttaatagccgccctaacaccattcttgtcctgaaccccagcaccgaactcggacacccccctaccttgaacctaatcctaacaccagttaccagtcacgcctattagcagccgatggcagatccagaacctaattcccgactcactgcccttgggatgagtcagtgcccaccataggaactcaaacctggaacctggaacgcaatctccttttgatccctggtctcacacctagtgttccagatcccaatcccaggttcccatctctgactggcagcccctgtcagtcaggactgggtcctgtccttggatgcacaaacttgtcttatcttggattctgtgctccaggccagtgcagaaaagctgtgccgtacctatgaggatcaactaagtgagaccaagatcaaagtggaagagctgcagcgacagctggcggatgccagcacccagcgcgggaggttacagacggagaatggtgaggcctggctttagctgggctatgccaggtagggtttaagtggtgcccctcaaccgactgactggcctgctggcccctacacctgcaggggagctgggccgcctgctagaggagaaggagtctatgatcagccagctgagccgggggaagacctcagcagctcagagtctggaggaacttcggcggcagttggaagaggagagcaaggtggattggcactggcaactgcagggcagtcgggtgggccctagggtcactagcatggattgatgctgaggccaccggtgtccctgcaggccaagggtgcactggctcatgcagtgcaggctctgcggcacgactgtgacctcctccgagagcagcatgaggaagagtcagaggctcaggctgagctgcagcggctgctgtccaaagccaatgctgaggtggcccagtggaggagcaagtatgaggcagatgccatccagagaactgaggagttggaggaggccaagtgagtagctggtgtctagaacataaccgatgagagattcgggcctgtgcctttatgtcctgtatgtggtggtcgggattctggggttctttccccaggctccctagtccatcctgcctgctgtgtggtccaggaagaagctggccctgcggctgcaggaggcagaagaaggggtagaggctgctaatgccaaatgctcctccctggagaaggccaagctgcggctgcagaccgagtcagaggatgtgactttggagctggagcgggctacctccgcagctgctgcactcgacaagaagcagcggcacctggagcgggctctggaggaacggaggaggcaggaggaggagatgcagagggaacttgaggccgcacaaagggaggcccgaggtctgggcactgagctcttccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccgactgcggcacagccacgaggaggcgctcgaggccctggagacactcaagcgggagaacaagaatctgcagggtaggaccccaggtccagagcactttagggtcaccttgaaattgggaataggaaagtcacctggagcagggcggatgtgagggtgagtcctccctctgtgctctgttcaccctgtagaggagatcagtgacctcacagatcaggtcagcctcagtgggaaaagcatccaggaactggagaaagccaagaaggcgctggagggggagaagagtgagctgcaagctgcactggaggaggctgaggtcagggctggccacaggggtgggtggactctggtccacgcctccctggcctggttggtctcacccaaccctgcctgatccacatccctagggggcactggagctggaagagacgaagactctgcggatccagctggagctgtcccaggtcaaggcagaagtggaccggaagttggcagagaaggatgaggagtgcaccaacctgaggtctctggagggcggtcttgatgtgcctacggtggcacattggtgggaacagccagtctgcccctgccacagggtcagggagctcccattccagatgtgatcctccacaagtctaaggatgctcagggccaaagttcagcccatgtccccctggcctctagtgaacttactgtttctggcaagtcacaagtcacatggggctttaaaacagagagaagcaattcttgtcccccaattgggttttcatctccgtgcatccttgggcatgatgccacaggtggttcccggcctgcttcattcctgcaggctaagtctgcccttcatgccaccctcccaggcgcaaccaccagcgagcagtggagtccctacaggcctccttggacgcggagactcgggcccgcaatgaggcactgcggctcaagaagaagatggagggagatctcaacgacttggagctacagctgggtcatgccagccgccaggcaatggaggcacaggccgctactcggctgctgcaggcccaactcaaggaggaacaagcggggcgtgacgaggagcagcggctagccgctgagctccgtgagcagggtcaggccctggagcgcagggctgcactgctggctgctgagctggaagagcttcgggctgccctggaacagggtgagcgcagccggaggctggctgagcaggagctgctggaggccacagagcgcctcaatctactgcattcacaggtggggatgggccaagggtgtcctcaaggattgggagggggcagagccctgctggccagctgaggctctgctcccctcagaatacaggcctcctgaatcagaagaagaagctggaggtggatttggcccagctaagtggggaggtggaggaggcagcgcaggagaggcgggaagctgaggagaaggccaaaaaggccatcactgatgtgaggctgggccagggttcgggacgagtgggtagagcccaaagagattctttcgccccctggccaccatgctatttcctccccacaggcagccatgatggctgaggagctgaaaaaggagcaggacacaagcgcacatctggagcgcatgaagaagacactggaacagactgtgcgggagctgcaggcgcgcctcgaggaagccgagcaggccgccctccgagggggaaagaagcaagtgcagaagctggaggccaaggtaccttcagccccaccttgccctgtagggctgaggctgaggcctgctcccctagcagacttccctcctaccctccgactgtcccgcaggtgcgcgagctggaggcagagcttgatgcggagcagaagaagcacgctgaggccctcaaaggtgttcgcaaacatgagcgccgggtcaaggagcttgcataccaagtgggttacggggtccatcccagggagtggcactggagctaacccagtccaggcaaaccctgagaccccctttgcttgcgcagacagaggaggacaggaagaacctggctcgcatgcaggacctggtggacaagctgcagagcaaggtcaagagctataagcgccagtttgaggaggccgtgagtacactggggggccaggcatctgggattgttcatgatgccagtggcgagctgatttcaactgcaggtcttgaagcccaggaggcatctgtagcaggctgcattaaagggtggcagccatgtctgctcaacccagggacttctatggcatgatcaccttcagctttagaagggaccaaagtgaactgcttccttcttctgcccaggcctggggatggcctggtgggaaagtgacacataggcacctcttaaaggacagtctccactttgggtccaggtgtggggaaggatggtgacaggaagagtggaggaggaccaagagaagccagcttctttctgggctgggagcaggttggccatttgttaccaaggggaaccaaggccctgcctatgcctctaggagcagcaggccagcaccaacctggcaaagtaccgcaaggcccagcatgagctggatgatgctgaggagcgagcagacatggcagagacccaggctaacaagctgcgggcaaggtccagggatgccctgggccccaaggtgaggaggcctctgtgttgggtgtgtttaagttgggcagacacagtgtaactcagactgtctcatctctcagcacaaggagtgacaccccaggctctgaagagggacacccactgcggtcctgctgtctcttcccatcttcggccacgccaccctccctgaaccctgaagaaaacacagggatgcacaccagccactgtcctgatttctggggttaggggagctgggaatagaatttcatggacaaagtcaggtccacatcagtctttaaaataaagttctttaatagtctccatttaattggtttatttgctgttaattggcaacacaggaggagccaagggtaagctctcagccaggctcctgtgtctgggctcaggcaggcacaggcactccacaccccaagggatggagagaaaaggccccccccccaacttctggggaaccttcgggatgaacacagtggccaatgagcgaagacccagaggagctaaaggaagacaagggaggtgaggagggaggggggaggagagatgggcagacctgggggaaggcagcattctccgatacccacccctgcctagggctcaggagcctctgtccaggccccgaggccagggaggcttggctcacaggggtctgactcttcctctccatcaggggactgatgggagaagctcagacagagatagtttcccatgttccctttctctggcaggccagagctccaggattgtgagggaagggtgggcacggtgccattgtccttaccctggggacagtgaggaaaacaggctccccaatgacccaggccctctgacccaggagacaagagcttctaggctgttccttccactgagcctatacctgaaaactgggtagacagagccgtggggaggcagagagggacggggacgggcagagtgtgcggcgtgtgcactcacgctcacccacacttgcccaggcccagcagcttcccgaagcctggctccagctcactcctcagtgaagtctctgtctatgtccatgtagggctcctcaatgtagctgaccagggcagagggcgactggcggtctgggttcaacaggatggacactgtctctttccagtatgagaagctgatgcaggaactctgggtggagagagggggggtgcacagaggacttgggccaagtctgctcacacaggagggacttggcaggacaacagtgagcagcctgtccacagaggggcaacctgaatgccctactgagtgaccctgggttcacatgccactgtcctcccatcactcaaggctggggcactcacattctccaggcaggtgctgtccttgtccttgtgcaggtaatgctgctgccaaaagcgcagcaggttgtggaagttgttgagcaggaagccagggtatttcttgctgtgctccattcgctgtagaagacgcagatagaggggcagcctctctttccgtcgggccagcatcaggatcactaggctggtgttgaggcagctgacattctcctgcaaggccaaaggcagccggactgagtgcatgtcagcagcctcaggatgccagtgaacctggacagccactgggcagggaggaggcctacacaggggcctggcataatccatgggcacaccttcatgttccctatgcccaactaccactatccacactgatactactagatggtccttgtctacatcttggttcaggtatgacttcttccaggagcttccatcccctgctggggctgggtgcatgggctggtgcactagaatgtgagttttagaagcagagtctcagttcaccttgctcaccaagcacccctcgcccaaggcccagtctcctaacatgtttggcaggcagcaacaaaaaaaccactgcacagggtcctagtatgactctcatcttagaaaagtgggtgtgaggctgggagaagagagggctgccagttagtgaaggacttggggcaatctcaggtccagttccaccgcccactgtagcctgaaggtagggtgtagggtacatggggaagaacgttggcttggagtcagaaggcggcagcgtcaatcttatctgtgtcccaactgactctgtgaccccaggacacttgatatctggtcttagttctcctgtaaactggggcactgggcgacaccctaggagaactacatttctagagagaagcgggggttggggggcacagataagagagctgatctccattctaccctcctttgactgctcattggctgggacgtctcacctgggttagtgtctgcacatggatgatattgatgaggcggaagaggaaggacatctgtgtgggcacctgggatatgtaggcaagcaggcggcattcggacaggacctcagccactacggagggaagcagaggtgtagaagcaggtgcatccagtggtgggccacccactccatggttaagccaactttggctgaagagatggcttaacggttaagagcatttgctgctcttgcagaggacacacaacggtggctcacactatctgtaacctcagcaccacagcactcaatccccagtcaccacccactcctgcactcacatgcagagccccatacacagacacacccacggacacacattgcagaagatctgtttgtacttcaagatgtgtctctgcctaaagtgccttctgactggtttaataaagagctaaatggccaatagctgggcaggagagagcaggcgggacttccgggcagagggagcaaaactgggaggagtaatctaggcacacgatttttgccagcagaactggaacaagctggatgtattgtagtaagcagaggtaaccgaggcacatggcagaatgccaattaaaaaatatgggttgggggctggagagatggctcagaggttaagagcactgactgctcttccagaggtcctgagttcaattcccagcaaccacatggtggctcacaaccacctgtaatgagacctggtgcgctcttctggtgtgcagatatacatggaagcagaatgttgtatacataataaataaataaaatattaaaaaaatatgggttaattaagctgtaagagctagctgggaaaaaaaaaagagactaagcgaaggccaagatttcataatagtaattctctggctcattatttgtgaggcggcagtccaaagatagtctgacaagaaagcctgttacatttggcgcctaacacatagcatgtaaatccacacagggcctgagaaagcgaaaaaaaaaaatgttcccagtaggctcccatgcttgaggcctacagaggccctgctaccaagcacttgaataggtttgaataggtttatgagcggcaggtgggcgtgctacttggaggtggtagcgcctagatagaagcgcctacaggcccaggctgaggcccaggctgaggcccagaggcatgacactccctctcaccatgtgctaagtggagccacacagtggagggcctagccatagcttaacagtttaaagtttggctaccacagtcagagaaggctgcagacatgcaaaaaagtcaggtctagattgagaatacatctaaacagatacaatatgcttaaaaatgtattagatgctaaagaaagaaaagaaaatgggtatggacagtcatagaaaaaaagtgtagcaggcttccttttgggccaccaaccagctcccaaatcaagacacggagacttcttattagttatgaatgctcagctttatcttagctcttatttcttgctagctctcataactacttaaactatcctgtttctcttcatttacattttaccttgggtctctctctctctctctctctctctctctctctctccctctctctctcctccttccctctctctctccctctcccccctggcatgcttctctcttctcctttgcttagatctcttctctgcccaccagtcctgcctacccctctcctacctagctattggctcttcaactttttattagctggaatcaagtgccttaggcaggcaaggtgaaacaaatgcaacaaatctttacacaattaaacaaatgcagcaaaaacaaatgtaacacacatttacacagttactattctgcagcataaacaaatgtaaaacatctttacatagttaaatattccataacaaaatagttttaaaaacaaaggttcttaaagagagtaaatataaaaggaaaaagatgggaaatatacagggtgtatggattttgtatggtgttttgttgactttaaatttttaaaatgctaatgaacaaaaaaatagctgctgagagacactggattatggaaactgctaaattaaaccaacaaatatattatttaaagaatatcttaacttcagaatagaagtcagaaaatacattgtgttgggggagaggttttgcttttgtttccatgggaaacaaaaagctatagatttcttcaaaatgaataaacaccagatttgatcagaggagacctcttgaaaattttggctacagacataaagacaccaagaaagactataggacaggtgatatgtattctgaccccttgacatgggaacagctctgagactggatgagacatgatgaatcttgctggctccagaatcctcatggcttattattacatgccagtcttttatgtgacatggatacaggtttagttatgcagtcctaacagacttttaaggttaacagatggcttttatacctgctcaaatatacaacaaaaaactcgtctttataactgacttatgtacacctcacagtccatgcttgagttaatttagatatataggttacctttaaaagtttgtgttttcgggaaaaagaaaaacaaacaaacaaacaaacaaacactgaaaacaagtagtccaggtggcccagcctctcagaatgcctctgttgcagtttcctcaaaattctacatctagaacaacttcaaagctgctgagatggtccagcctctcggaatactccaggcaagacttcagataagccctgcactttcccaccacacagagactaaacaaaaaataatacagtcaaatctcgcccaagattcgatcattgtcccaatttcctcagggtcctctagagatgctgttgccccagacaacaggaagcagtctagagaacatgatgcccacattctcaagaggtggggtagatgatttttggttgttcaatggattatggatgcttatcatcatttaggggggtgggctacaagttgttgttggccatggtcggggagaaagttgagcaaaggagattagattcagagacctcgttctgaaaaggaaaaagggagatatggaaaggataggataaaagggtagattattgaatctactttaaactaaaaagcaagtattaatctcaaatatcttacactggtatggattttttatattgatacaaatttaaggttttttgtgagaaaataatatatatatatgtttctattcttaagatatttttgtatattaatacaaatttgaggttatttttgttatactgtatatatgtttctactcttgtttacggtagtatacttatgtaactctaaaaatgtaatatacaattgggaaatgcaggttaatagtcaactataataatcaaacttgtcatgtaaggtatattttcaaggttaaacagatatacattttaaatagataggtgatcttcaaacacttcaatatggcatttacgatgttttaataactgcaggctttttataacagtgagacacatttgcttctggcagcaccaatttacttcataaaaggatgatgggcatcgaaaaacctccacacagagtttgctttctttgtatcaaaagttagccgtttgaacaagaacttgcccttaccttaactgctgactgtatgctttccaaactggacaagcaggacacaaaagaagacaactgccacactttgtcaagacaaggtaagacagtccttcaaaattcctgcttcaccgaaaagtctgtcagatatgctagacctgtaggccaaagatggatttcctaatgttgcagaggaaccttgggtgactgtccagacagccagcagtctctgtcatttctatagttttggaagttgcttgttctgcacttcctgtttactcagttaatataatatacttctcgggtctttgatgaggttgaagcctagatagttatagttacagttttccttgttaccaaattcagaaaagacactcacaaaagagagacataaaagtttaagttgtttatctaagatgtttaaagtctaaaaagacattttaggatggtaatacaagttagctgataaaaagtggattaggtataaaactttggactaagataggatagataatacagtactttctcctaatttgtcaaatgcaaatgttctggacattgtgaatgtaattcttacctgataattgttcttattgtatttagttttactatgttagagttaaaacctttcctttttaattagacaaaaagggggaaatgttacggaatatttgtttactgtgtaaagatgtgtctcctgctaaacgtccaatagtaggcaagagagactaggtagactaccaggcagagagagagaaactgggaggaggaatctaggccactcaatttcatcagcagactcagagcaagttggatatgctgtattaagaagaggtaactgggggctggagagatgactcagaggttaagagcgctgactgctcttccagaggtcctgagttcggtttccagcaaccacatggtggctcacaaccatccattatgagatctggtgccctcttctggtgtgcagatatacacaggagtagaatgctgtatacataataaataaataaataaataaatagatagatagatagataaataaataaataaataaaatctttaaaaaaaagtcaactccattaaaaaaaaaaagaagaggtaactgagccatgtcgacaaacatagatttaaaaaatatgggttaattaaattataagagctagttggggaaaagtctaagctaaggccaagctttcataattaataagtctccaggtcattatttgtgggatggcagtccaaagacagtctgataagaaagcttgctacacatatataattaaaagtaaatcaatgacaaaacctaactattaaaagctgcaacaacagtatcaatctccaactatttgtttatcaatctaaaccaaatctcagagatccaattggtgcttgagaacctcgctcagaaagtggccctcctgcagctctctcccagctgagtgggcgcccagctccagctctcacctatattccttctcaggaagacaggatgataatgaccattaagaaacagcaagtctggggagatggcccactgggttaagtactgttacacaagcatgaggttcagagcttagattctcagaacccatgtaaaaagccagtgtggcagcgtacacctgaaaccccagagctgggggacacagacagaggaagaaccctgaagctcactggctgaccagcctagccaaattcatgaactctaggttcagtgggagactctgttaaaaaattaaaggatgtcaaactctgacctccacatgtgtatacacacatgtgcacatacccacacatacataaatcacacacatacacacacacagagagagagagagagagagagagagagagtgtcagtcaaattcaaactacctcacagagctcctactgtgactggctggtttacatgtctctgtccacttctgcagcctgtacgtaaagagcgctgagcaaatgacctcctgtactattgtgaaggtgatcaatacctgcttacactaaagtctatgtgaccaatctcctaaaacagacccttcagagaagaaacaggaggtaaatatctaactaaccatgaccaggatatttttcactaccaaagacaatgatgagggatactgtccttttttagaagtgctcataaatttgtgagaaactgcttagtgacacagacctcccagggaagaaagcgcgtatgtccaaatgtatagctacacacaattctggatgacgtctgacaccccacccaccataaccacacactacacaggaaaacagaattgctagcagtcagtccagaggaaggtggcttttcccttcactacaatgttatacttgttcactaaagggagcacaatcagtggagaagtcaacacagctgagcaatgcagccaagcccacctcttgaccccagccacacatatctgggaagtaattcagcaattcctggctggaggccaggtgtctggcacgcatacagcacccatttgccttggtaccttggctgcctcacctttcatgtccacctggttttcaaatcggtccaatgacagagtaacacagcgcaccagcatgttggagtccaccagggagctgttgatctgcttcaggaacacctggaactggtgcagagatgatgctcactagcaggggctgctagccggggaccactggtctaccccagctccactgctctgccaacaagacacactaagtggcctgctctcactgctgggctgccaggatgctgtaacccagccaatgtcctcatcccaaaattcttaggggctggctcaaagcctgacacagagtaggtgtagtgaacatttgctgactgccctttgaatcccagactcttccaaatgtgtgaccacacctgaagagttgcaggccaaggttcacagacaactgatgctgcagcaaccaccatggagctcctgggtgagccttacctttgcatcagtgttgatatatttattgaatctcttgaatgcatcgacattgaacttcatcagctctcccaggaggtcaaagtagctctggagtacatccctcgacttgcactcgctgtccacaatgcagtataagatgtgctggggtgagcaggggacagggtgagggtgtggatgggactgtccctacctgtttgccactcaggcctggcctggagcttagaccactcacttgcttccagcaagcatccaggtagatggaagctgcaactttgtctaggttctctgctgagggtacttggagccaggggagtaatgtcagcagggggctgggtgggcaggggttctctgctagagctgaagctctgtctccagatctaacaagcactgctgtccaagcactagggccacttaagtaaatgaaggacagaatttaagggcagcatacacattttgaccctaagagctgtctttgtgtttatcaatgaaattgttaataacatataaaaatcagtaagtatttatcaagaatgaaccaatttaactcctgtttccaatatttcccatttttgttttctgattggttgatccccctccttcccttccttcctttcattactgtttttttttttttttggagggggacgacaggatctggccttgaacttgcaaaactcctgcttctgcttctgaagtgctgaggcttccaataagctcaactccttttccaaacttaactgatttggcggttattttcctttagaattcatgggccagttagtaattttttaaaaagacctagtgtaacttggccatttgctctcttatgaatttgctttttctgaaggccattgatcaataagggaatattaatttttagtcaatactatatcattctcagggtccagggatttgctgggtaactccatagtctatattcctacatgattattcctgagtccctcagtcacccatcagtacctatagggaggggcccacagctggcaatccagggcaaaccctggagcaacatgcacttggaacaactagacctgtccctaaccaaagtactcaaggctcaggatgagacatcaaggcaaggggctggggaggatggtcacctgacacctggttcgtcagccatacctccagaaggcctcgcttcagcaggaacatctggtctgcataggaggtggtccctcggaggaaactttccacagcccgggcctgccaaaacctgcaacccaaatgttgacccctggctatggctgccctctcctggttgaggttcaattcccccagggttggagctatttgcagccaagtatctgacatttactgaacattttccagttctgggcctcatccttaggtcttgagaacagagcagtgaacaagggaacggctgtccttctatcatggctcacaactcagcagggaccagtcttccacatgactgtaccagagaaggtttgtatggcagaggtagtagcatccaggcttaaaaagtggccgctagttaagtgccatgtgaaaacactctcagaagactggaaggacatgggcttgggagccagggaggtgtgtggccagcagcagagcatgtgtggacaagccactgagctagaaaagaggtggcagacactgagtagcccagatggctcagctgggatccatgagggaaggtctgactgggcgaggatgaggtgacagggaccctgtaggcacagggctgctggaatcccttgtctgcagccttcacaactttcctgaggtgactaggaactctgcagccttctccttggtgcctggtcacctagcagatggctcctggggcagcttctggctttgtttttcccatgctgactgaagcaggtgtctttcttctcatgcttatttcctatgactccaggtaatgtcacacaggcagggccgggatcccatttttgccccatctctctagtgccagcttgatgaatgctcagtcctctcctggcataccatgtcgacgggggtacacacacttaccatctgagtcatacggagccagtggcaatgagggcaacttcccccattggtgaccactcttaaggaatgggtactagagactaaccaattgggaaagccctggctcctaggccccgaagtgcacctgtccatagactcacctgaaggaagactctgctggctccttcttcatgacctgcagcagccgagttagtaagcccctcttgccatcacacaccaaactcctgaaagcaaagggacagagcactggtgacagacctgaatggctgacagggaccactgagctaggttcctgtgctcatgtagatggatgacagagtaggtgaagcaaggatgctctcttcttccaccttgtgccaggacctcagacacactgcagctgtcaatccaacagcccagtgcatttctattgcatcttaggccagttttccctcctcagactggctgggaagaggcagaggcacatccagggccagacatggctcagaacagccagaggaatggccatttatatcacaagtgggtttaatccaggccacagcagagtatgccagatggaacaaagtttgtgccaattgggcagggcccaaagttccttttcctgccccagggtcagttccagctgaactgtgggcttccaggccttagcttcttgtctgcgaggcaaaggcagtaggtaagaaaatgattaggcctgtcatggtgtcaggtgtctgggcccttaaattctctcttcacacagcagcttcacttccaccccctgtagacatcagggtggcgctgtgctcatctcatcaggatgctggggagttatggctctggttgctggataaggtccacacttcataagctcctgtgagcctggcatgtcactgtgctgttcccaaagatgaggcagacatagccagtacacgggacttgattcttggcagggggcaaagatctgcttaccctgcttggcacagttgtcactggcaggggatgaggatatcagcaaaggggccgtttgcatgggacaaggtggaaggacagagtacagctgacctttggcaggggccacttgagacatgtcctctacatacagagaggaaggtgatgatggcacttccttctgagggctgctgtgatgttcaggtaggaaatgcagatgtgagtatctagcacatgaagccggcggggcatggtagctactcttgagacagggcaggtatgcacacctgtgtgtgccctcctgcaagccctgtggctacagctgtcccccaccaggatcacctgtcagtgttgaggacagcttccacctcagggatgttggctttcagagagatggcactgagttcatttagctcctgattgttgagcagcaggtacttgttcctgaaacaaatgggttcaaagggtaaagggcaggaccggggctgctgaacagcactgctgtggaggttctgccccttcctgtggggaagagaagctgagaacccaccagcacttccacacctggttgtcactcactgccaatgccttcccttggcatctccagatctccatgttgtgcactgaacatttctatatgacttctcaaagtcacctgcacttctgcatggccaatcccatctgccatcttattcctggagtctagccctgctgcaccattctcagtggccagagcatcacataagcagaggcctgaccaactgtcacagatctgtcttcttcatccaggctcgtcatgatgggtctgtgctgagacagcatcttcagctgtctcccacaggaagggaaccctcacacagctccttgagggattttcagaacagggcttagaccctgtcattattgaaaatgcttcccctagctcccaccacttcagctgtgtaatgcctagggagtgaccatgactcaggccctgtgcagccaggctacctctgcagccacactacaaaccgagcagcttacacccaccacaccatctggccactctggttttcatgagcaggccatgtccttcctgcagtggcttctccacatgtgggccttctggctagaacactctctcacgcttcctcttcatctcattcaggcctctgctcacaaattgcttctgcagtaaagagtcactgagtgccagctggccagccagtcaggaaacctgccactgtcctttcacagaattgtgctcttctgtccccaaatactaggcccatttgtcatcatgcattcttttactggtgaccttttctaatgttatacttccttcccagatgtgcccttcacgatagcatgggccaaagtttccattcctcactgtatcctctgagccaggcatatagaaatgctgatttgagagactgatgaaagctaggaacagacacagacacacacaaccacctaaaaaacccaaagacaaaaagaaaacaagtgtaattctgtaacctatgggtgccttcagccatagacatcctcccaagagagaatcacaaagagacagaggcccctaggccacactgttctcacaagagagaatcacaaagagacagaggcccctaggccacactgttctcacaagagagaatcacaaagagacagaggcccctaggccacactgttctcacaagagagaatcacaaagagacagaggcccctaggccacactgtcctagggcatgctctattagcttgtacaatgctccaacactttaaatcaacatttaaaaatcaggttaacccccagcactgtgagaaaatcaaaaggacaaactccccattgttaactactctaggcagttcacagatgctttaatttctttgggagactaaaaaagtaaaaataaaaccagaagccatgtaccagtgtgcccacttccttgtgagcacacagttgtggtcaccgaagtccttactgtaaagctcagatcaagatcgtgggctttcactccctcccctgcactgttttccttatagtggacaaccattttcatgcacattctccatgaaaagcttaaacattaaaaatcaaagaggagaatatcttaaaaagtgtgtgtgttgtgggagtcaacacatttcactgtgagggggcagcagttgtccttttagggggctgtggaggtgcaggaaaaacccagtacagatgaaggcgggacagacactccaggacaccgggcagttcccaccagccctcctgagtccaaggtcagagaggagattccgggacaggcctgtagacggcacctccagggcacacatacttactcatggtggtcactgaaactctggagaagcctcaaaaactggatcttcaaggtaatgtcctataacaaaaattaaagccacaagagtcatggcacttccacataaaacaagtgagctctggagacatctatcttgctacactgcttcttttgagtccctgtcctcaagcacagtggtggtttttctttagttgaaaagtcaggtgttcatagctgaccagtgtcaaggtaaactaatgtagactttttaatgtagactttttctgctaacaacattcttgcatattagatttaaaaaaaaaaaaatcactccagtccttttacatatgatgctgatttagaagctagaagaggaaaccagagagcccaggcagagatgcttaggagctgagggaggtgtgtggatgagagaggagcctagttacaacaaggctatggcttcagtgccctgcagtgaccaggcagaactaacctgtgagctagagagctgagcaagaaacctgcctcttaggcgtggctggtaggagctttctaggagaaatacctaactgaatgacggggccaagaaattaaacattaaaagggagctcctttgaaagaactagctcaacaatgtccaggcagaggctgtacaggtccccaagatggtcccctcccaaacaccacacatgccaccctgagggtgtaaaggcccaaagacaagctaatggtaccacaggaacatctccaagggaacaaagaaaacaactgacaaaccattagagataaattgcaaaaggaaaaacagatgtagtgtgtttacctaacaaataaagaccaactggtctctgaataagtcagatatgttatctagacatgtaaactatactccttttaaattatttactcaaatggacggaatgaaaaacaatctgacagggccaaagagaaggacacagcaggaggcaggcaggaggcaggcagggggcactgaggaagtgcaggttcagggacccagggcacaggcttctgctagctttacagccttcaggttggagcaccttcctgctaatggtgtgggaaggcatatggcctgtcttgtcagagaaaacggaagctcagagattctgtgacaaagctcagtggcaaaggacttccagttctcagtttaacgctctatctgggtattctgagaaacaaagaccttctgttctcatcttcaagaacaagaccctcagggaatcagcagcagcacccctcctcttaaaggtttattttatttattatgtatacagtattctttctgtatgttggcttgaacatcagaagagggcatcagaacccattacagatggttgtgagccatcatatggttgctgagaattgaactcaggacctatggaagagcatccagtgctcttaacctctgagcatctctccagcccccaaaagcagttcttaaaacagccaactcatagcagttaatatcctgaatgttcccaggctctcttacttaccgggctacagtcacagttctggttgtgaccatggaggacaagggcagatgctgaatgcttcctccaaatcagtttgtcaaacaaattattgagtcctgggatcaacttgaactcagcaatcatcctgtggacctgtgtggggtgggaagggagaaacagggagaccaatgtatgccccagatcagcaaggcctctcctcagtacaaatggccatcctcaggatgaagaaagcaattgccagaaccgagtgctgccatttaaagatggcattcacacagcatctaccctgactgcacagaaaaaccgtccttaaaaatttctgtatgtgagtatgtgcacatctgtgctggtgccctcagaacctagaaagggtatcggatcctctgcagatgcagttataggctggcctgcaactaactatgaggagtgagtcatcctatttggcttagaaaaaaaaaaaagttttgttttttggtttttcaagacagggtttctctgtcctggaacttgctttgtaatccaggctggccttgaactcacagattcacctgcctctgcctccctagtactgggctgacaggcatgcttcaccacacccagcagcgtgagcagtctttatggtctgtttttctgtggtactctggtcttttgaggacccattagaatctcctgttaagctgtacacattttctttattaggtttctgtgtcactatgaaaggcagtctgaaggaggaagatttgtttcagctccctgtgttttacagatgtcttgtgtggagatgagtggtagaacagaacagtccccgttgtgacaactaagaggcagagaaaaagacagggagggcaccagggacaagaaaccctgaatgatctaccccccagtgatttactgcctccaataggtccttcctccttgatttgagaaactcctgaagtgttgctgccacctgtgaactgatggctactgatgccaaagtcagataagactttgtctcctttgcccatctgaaaaagcaaaattgtttgagatatgaatttctctccatactgtgaggttgagcttttcttgttgtgatttaagaacattttcttgggactggaaactaagaaaggacaacccagagtcaggacaaccagggctacacagagaaaccctgtcttggaaaacaaaaccaaaacaacaaacaagactgttcatgaggtttcagaggaaataggatttagaggtcattaataatacagtctggcaaataacttgcttatattctgcctatatcctaaagctttgtgggaggctgagtttaaaggtgacagacttaatttggaaggaggaaattttaatatagcatagcacttgggctgtggcatggttattgctggctgcttctagataattttacagtgaaaactgggagcaaaaaacagaatttataaagcaaagtaggttagccagaaaaagaaggaattgaaagttgtggataaagatgggaaagagattagggtcattaaaaagaagccaagcactttgcacaggaatagaaaacagacagggaaagtgcctattagactccaggattagagggatcccacctgccccaggcttaggtataaggccagaagcttattggaaacactctcctgagagcagacagtggtcagggtgctttgctcacacaaggccatctatacaagcacactcccatgtttggcttgccagacactcaaagaccactgtagtggcccaaggaggcatagccattacctattttagtagcacatgttggtatcactcacaggatattagttttttgctttgtttttatgacagtgttttgctatatagcccagactggctctgaacttctgatcctcatgccttctcctccccagtgctgggattatagatttacaacactatgtccagctcatgtgatgctggttttgcagacgtgtaaattgcaagacttatggaatcgcgaggctttcactgagatttcaaaggaaggtctagagcggggagatgcatgaacccaagctgtgatggagagcccaggatgtatgtatagcaaccacagagggagctgcaagcaatggtagagtctgtccgggagagatgtcaggaaggctacaatgacaaggtcacagggcaaggctcccacgccacttaagttcacctcaagaaaccacactccttattctaaacacagggctacaggtttctctgatgagttttggtctcactttcatctagcctttctttgccagtcaccagaggacctgagtttggttctcagcatccaagtcaggtagctcacaactccagctccaggggctttggtgtcttttcctggcttctatgggcaccagcacacatgtatgtgtgacacacacacacacacactcacacacacactttattttacaaggcttataatagtaaaaggcttggtgctcagtgttcagctggagggtctactttggagagctttaggaagtagaatctagtctgtctccagcttttcctcttggtttctggctgcaccaggaggaaaaataaccccctttccctttccctttatgatactttctcaggtgtctggtcatcagtgcaaaattctggctaattcagcaccactttggtgacttggacaccagccatgctcacaagtttctggtgacagggcacgctggtacaactgcaggaggatgtttgggcactactcctcaaatttacaaatctgtatttccttggtcaacaattccccttttatcatcagctggacccttatacatgataaatgacattatgtactacatcagtggtagagacattataatacccaatgcagatataatttacactcagttaaacaaataatgatacatccaaatgatgggataaacggaaaagaaagaatccaagtttttcacagatgctgagctgtgaacaatcaaagaaatacaagtgtgtgtgctgtattcaattgaatgtataaaaatcgtatttgtgcctgtaagtataaaatagctatagaaagaaatactgacaatggagaactcatatgtactccaggacgctgaggcccaggagggggataggctccattgattctactagtttgtattaactctgggaattatgtgcctactaattttttttttttacataacatgaaacaagacccttgctacctcgttaggacagactatccctgctatatgcacagccagagagcgaatgaggctggaaccaaccctacgatcagttactgttattctatgggcagtgaagcccagcaagactgtcctagacaaggtcagctaaggacacgctacaaactcaggcatcttgtcctgaggtctgcctctttctagctaaccactggaccgaggtggaagaggtaggttacaggggaatgtctttggagggtattatttaagtctccctgctggtcctgaagtaagcaattttgctctgcacacttttcagtcatgatgtgtgacctagttataggccaggaaaaactcagtcaagaaagcacggacctctgaaaccatgagccacaataaaccattcctccctataaactgtttctaccagatgttaccatggcaatgagaagcaccagttttcaggtttcacagtgagcacagttctaggctccgatcgcatatcagagtggcagctgctttactgcacctacagggctggacctttttttttttttaagataatgttttaattttttgagattaaattacatcattcctcttttcccttttctccctctaagccttccccccattattccttccccctggctctttcaagtcatggcctcttttgtttttagttgttatagagtgtgtgtgtgtgtgtgtgtgtgtgtgtgtgtgtgtatgtgtgtgtgtgtgtgtgtgtgtgtgtgtgtataaatacaacctgcccagtctatgttacttctatgtatgttttctgggctggccatttagtattagataactaactggtgtgctcttcatagagtcagtcttttttttttttttgagtcaaggtttctctggtgtagccttcttggctgtcctggaaatcactatgtgcaccaggtacatattgtcaatctttaatcttgcattactaaaataaaagtttgttcttggctttcacaatcactatctagaaatgctgcctaaagcccagagcagacactccaggctctataatcagtctagtttccttacgaggaggcaaataacgcacagaaagggcaccaagctgagaagacctggtgaagttacacctggcaccccacaggttatgtggcatttgctctcatctctgaagtaagatcctattggttttatcaataaaaacacaaagtcagatgtttaggtaaatgctgagagatcagagaagcaaagaagcagccagtcactttttacctctctgcatcctcagaccgaaatagccgacatcctgtcatacctggtcttatcacttctgtctctgtcccatgttgtcacttcctgtctcctctttgtctagtcctccagacctctatggttaactagtggatatctccaccctctgattccaggcaaactttatttgtcacaacacaactctcccattctgaggttggggagcacccacctggtttcgttgacgccccatcagcagcacacacaggacgtagagcacttccagtttgtacatgatttcatgcataatcttcattgactggggcagctgggtcctggctgaggtatgcggcagcgcattgtcccctgaagtgcctacaggaggggacacagtggaggctggcgtagccccagtaagatgggtaaggtatggctccctgagaaaacctgctctacccacaggcctgctgtgaagggattggatttagagagccgtcagacaggactcaaaccaccattagacattttaaaagccaggaaacctcctcacacctgcaaggcctcctgtagttctgcactctccaacactaagtaaggcattctgacacagccagtgcagtaagtagcctctccctgctgcttcctgtcaccaaccagtcagtcagtcagatgtctggcaccaaattgtggagaccactcttcaggtctccagtgaccaagcatttggtgctgtctacatattgctggcagcaggagttccagttttataagagttccctttaaggaacctctcttattcactttattacccacttgtgagagcccagcactgggttcttagaagagatctgaaaacggacagtgatgcacgaagatggtaagaagctgcacggtgcagtggttaagagcacagacactgggccaggctgcaggtctaaccccaggcctggctctgtggtgttggggaagttgaattacttctttgtacttcctagtcatcctcatttgtgagacagtggtgatgtcagtagcaagtacctgctactgttaaaaggatagaaagaattaacatacagaaggtgcttagtacaatgcccgaacaagtaagcaacatacaaggatgttaaataaacttaagaaaagaaaaagaattcttctgctaatgcttgcctgctgtaatttagaaatttgaagttaactaatacataaaaacatactgtacttattaatggggcatattagatgaagttttgattagatagacatacaaatacattgcttaatgaatggcttaatcaagttaaacattatcttttcaagcatccaaaattctctatgttttttgagatatataataatatagtatatacttgtctataatcccaggcaataacccactggaactttttgtttttattttcatttatttatttggtttttcaagacagggtttctctgtgtagccctggctggcctggaactctctaagtagaccaggctggacttaaacccacagagattcatctgcctctgtctcatgagtgctgagattaaaggtgtgtgccactactgttgggctttttttttttaaatttaatttaatttacttatttattttagggatggtcttacactgtagacctggctagcacggaacttgctatgtggatcaaggcaggcgtgaactcagacatccacctgccactgccttccatgtgatgggactggtgtgtgctgccacactctgcagactgggattcctcattgtcatctaactgtaagtcaggcacttgtgctttcttttttgtcagtctgtgtgctcgtcctggtagcccaagtggcagcaggcaaagctgaaggaaaaaatgtaccattaaaaaaaataaatctaagtgagaaaatggtattcatttagtctatttttctctacacaggagaaaagccaggctcactccatccccaccaggatatcctcgccagcaccgagaacaccaggagagtccagtggtctaaggagactgggcagcagcacacagactcttgccttagccacacttgagtcttgaacactgttatttaactggctctatagagctctggggaggcctggaggaggacacagctatgggaaggaggaggtccagaatggtacacatacaatgctggcagtaaagagtatctatgagggagggctggggagggcaggtcatgtaagtgagcacagagagaaggcagctggaggggcaaggtgaggaggagggaaaggagagaatgtggagtatgaattgttacctgatagttttaatttgtagttttttaaatggcaaaagctgttgggcaggttttcatatgtattcagccttttttttttttttttttttttttccctttttggaaaaatgtctttttggatgactccattttccctatttggaaaaatgtctatttggatccctgcctatattttggaatgagctgtctttttattattcttttttgtttgtttttttggtttttcgagtcagggtttctctgtggttttggaggctgtcctggaacttgctcttgtagaccaggctggtctcgaactcacagcgatccgcctgcctctgcctcccgagtgctgggatgacccccgcccagtgtctttatttttcttctacagtgttcttcacatgctttgttttttgattcatttgcacgtttgtgtctgtgtgagaccagaaaagagctcaggatccctgggaatcaaattcatgtcctctaaaagagcaacaacagcgttcttaagaacgcccctgggccatttctttagccccatattactgggcactgaacacagggtctcacttgtgctaggcaaattacacccctagacctctttatacattctgtattcaagtcccttattacagacatggtttgcaaagccattctgctcctcgggtcagtcttttcactttcttggtgatattttgaagacttttatgaaatctaatctgtgactactctgctgctgtgcttcagatgccacatctgtgaaatctagtcaggaagaccttcccttctgtttgctctgcacttcgtatgcttcccagaggcaccctccatacctgtctggaacctaacatttagttcagagacctgaaaactgtctccagggtcccttagagcaatctgtatactcccaaagaggccgcttaattggctgcagaaatttcttttttggaggtgagggggatttttacatctacatgtataagatgttagtctgtaactttcttgtgatctctttggttttggtacaagggtagaacttgtctcaaagaatgagctgagaagtgtttgctttatggaagagcttaaatgttggtagaattcaccatgaaaccatgaggtacagggttcttattttgagctgcttttgcatccctaattcaatcaattaatttatcatacaaattctgattttttatttctttttatgaagtaaagtggaacttactaaagttttaatacagtcctggtgtaggaccaccttagggaaaattctattgtaagcaattcttaattctccacagaaagaccaacaatgtctccaaggggcctgaaaagactcaccactcaagaggcccacaaaaagtaccttgactgtgctcagactcctcactggccactcgcatcagggcatctaacaccagcgcgttgtctagccatgtataccactcctccaattcctgcaggaagctggctgtgcctgttgactctgacacttttctagtcgccagtttgcaaagccgttccacaaagccagggatgctgagaagagcagctagaaggaaaaaaagagaaggcatttacagaacagctctgcagtcctgaactgtgacagggatggctcctttgttccttttgttgtcttcagttgagaaagcgtctctaaggcccaggctggccttgaattcctgatcccctggcttctacatcccaagtgctagggttatagacatgtgctaccccatccagccaggaaagactctactgtgatagcagccaggggtacccttttaaaaacaattaccaaggggctggggagacgactcagcaccacatagtagctctcaaatgtctctaactccagttccagggggtatgatggcatcttgtggcatccttggacaccaggcacccatgtggtgtacagatatatacgcaagcaaaacacccatatacataaaataataaaaaattaggtagccaggcaagttggtgcacacctttaatctcagcactcagcaggcagaggcagatggatctctgtgagttcgaatccagtttggcctacaaagcaagtttcaggacagccagggctggtatacagagaaaccccgcctcaaaaaataaataaataaatacataaataaatattgaaaatgaaatgtcaagccaaaataaaatagcaacaaacttcagaaacaaggtcagattttagatgtgtagggaaactggctctaagtgggaatataaatcaaaatacctttatgattttagtgtgtgtatttgagttaaatttttgttaaatttttttttagctacaaaaatatccagtcatataaacaaaaataagggatagagagacagctcagttagtaagtgtttgccacacaagcatgaggacctgagttccacccctagaaccatgtaagaagctggcccttagagccagcctagcctaattggccagccataggtctgtcttagctgggatttctatttctaagataaaacaccacaaccaaaagcacttgggggaagagggtttatctcttcttattcttccatattaacagtccatgactgataaagtcaggaaaggaactccaacaaggcaggaatctggaggctggaactgacgtagaagccatgggagagtgctgtttactggctcgctcagacctctttcttttattgctcagaatacacatgcaggggtggtaccacccacagcattctgggcccttcgctgtcaattagcagtcaagaaaatgccttccctccccaccctgcagacttgcctatgggcaatccactggaggtttcttcccatttgaccctagctgtgtgaagtttacaaaaactaacagaacaaggtcccgtatgagatgatgtatggcatctgaacacatgcatgcacacaaaaatctgtacagagatattcaatgactttcttttgtaatggtagaaatatggggatcactaaatgtctatcatttagcaaacagaccacatacgacaactccatatagaatataacggactttaaaaatgatgacgttttttatgtagttcttcaaaacacttctttaaggaaaaaaacacaaattattaaacaatattgatttaagcacatttttttcccaaaaatttaaaggacagaagcaggactggggtgtagctgggtattgggcacatctaggctgcatcaggtcatgtatttaatccttagtaccggagaaaaagaacagagcatatgctttgaggattcacagtggtgtctgcttatgaacaagacaggatagaaacaacacttcagaaactgggtgtggtggtggttgtgataaagaatgtttgttggccttccagagaacccaagttcaattcccagcacccacactgaggggcctgtaactccagtttcaaggaatctgatgtcctcttctggcttctggtgagacatacatgggatacacaacacaatacacattttaaaaaaataacaaaaattgcatgtgtgacttatggaatatccctttacactgtgtgaagatatatcattgtgactggtttattaaaaagctaaatggccaatagctaggcaggatttgggggcagagagaatgctggaaaggtggagtcaccagtcagatgcaaaggaagcaggacacgtgagacatgaggtaacaatccatgagccatgtggcagcacagaaattaatagaaatgggctaatttacgttttttttaatataaaggaattttatttatttttattttctgtacattggtgttttgcccttggtgtcaggtaccctagaactagagttacagacagttgtgagctgccatatgggtgctgggaattgaaccctgtttgtctgcaagagcttgtcagtgctcttaaccatcgagccatctcttcagcgccctaatttaagttttaagagctagttagaaacaagcctaagccattggctgaactttcataattaataagaagtctccttgtgtttatttgggagttggcaagtagacagagacttgctacaaatgacatccaacgtgggggcatgttatttccatataagacctgaaaaagcttaaaaaaaaaaaagtttccaaacacacacaaaaaaaggaaccaaacatggcttcctagtcctgcagtctctcatggggccatggtacagagacacatctcctggctggctgctggctgcgaaaatatgttatgtcaggaaagaggttatgcttttgtttccacagaaaatgaaaggctatggattcattcaaggttgatagagagcagatttgataggggaagaatccctgaaaatcctggctacacataaagaaataaacccagaaaaactataagacaggtgacatattttacctgctcaaacataaaacaaaaaaattacctttggctggattgggtacaacacacagtccattcttgggttaatgcagatatgtatgctacctttgacagtatgtgtgttttcagagcaggagcagcaggcaccagtgaaaacaggtggtccagcctctgttgcagtttccccagagttagttccacattcataacagcttcaaggctactggctgagatggttcagcctcatgaggactccagtcgggacttcatataagccctgcactttcccattacgtagagactggataacaaatgatacagctagctctaccgggacttgaccattatcccgatgttctcagggtgtcctaaagattccagagcccccagacaacaggaaacagactagagaatatgacacttaaattcccaagaggtaggataggtggttttggttattcgatgggttatggatgcttgttattgtttaggcggatacagaaatataatataggataaaaagacagccactaacctcaaatattttacattggtatgggttttggtaattgacacaaatgtaaagttatttatgttatactaaatgtatctttctactcttgttggggtattgtgcttatgcagctcatttaaaatgtgttgtataattaaatgcaggttagtagttagttatctataataatcaaacttgtagtctattacgtatgcttttaaggttaaacagatatattatagtttcagaggttcagttcattattatcatgacagggaggatggcagtgtgtaggcagacatgcttgtgacggctacatcttgaccagaaggcagaggaattcaactgactgtcacactgagtgaagcttgagaaaagagacctcaaagtttgcctcccacagtgacaccattcctccaacaaggccacaattgtaacagtgccactctctttgggggccattttctttcaaaccaccacagcagtcctttaaaaattcctgcttcataagattctgccagatattctaggcctataggcagaagatggatgccccaatgttgcagaggaaccttgagtgactgtccaggcagccagatgactttgatttctataggtttggaagtggtttgcactgcaattcctgtttactcaggaaatattatgtccttctggggtctttgaagactaagtagttattagtcattagttgtggttttactagtcatggtaaaaggtaaattatgtacagagctttgaactcaagacagaataaataatggggtattttctccaaatatacaaaatacaaatggactagatgttttaaatgtaattcttagctgacaattgttattattatttatggttttcttacgttaaagttaaaacctttcctttctatttagacaaaaatggggaaatgttgtggactatttctttacactgtgtgaagacatgtcactgtgattggtttattaaaaagctaaatggctaatagataggaaggatttggggggaggggaagagagagaatgctgggaagaagaaggtggaatcaacagccagagtcagaggaagcagggcacaaaggagatgaggcaacaagtcatgagccacatggcagcacataaatgaatacaaatacagaaatgggttcatttaagttataagagctagttagaaacaagcctaagctattggctgagctttcaaaattaataagaagtttctgtgtggctatttgggagctgcaggtgggacagagaaagacttgctacatgagaccttattgctgaagacaccatacacttcaggtgtaggacttggggaaacaaagctggaatgtgggcttcctccctgctttctggagtaccacaagtaccagaaggtgttattgaagctgctgggggagaactgtcatcaaaaaaaaaacttactcagctgtggatcctatatgctacactactgaccaaccagcaaaagtgcccatgggtgtacaagtggcaagtccatagtggggtaaccaactgctttctaattggagtggaagcctgttccataggaggaactctatgtttggtactgtaagcctggtcaaaaaccagtggtcaagtaggtcacagaccacagtggagaagctactgctgttgttttactaaatggacacaatgtgcctatcaaactgctgctctcagcactggtcagagaggctcccttttacagctggcagtggtaactgcagagattcattaactagtccaaatgctgagagcaaaagatgcttgaatactgtgccataagctggcatccatattacccttcaagattcaaacaaggaggaaaaggaggcaggaagaatttaagaatgatagggaaagaatgtatgagtggcagggaggggtggagggaaacaggctgttatctgggatgcccagcactgctgcatgcttcacctcatagcaactctgcttaccagaacaagacctccacacacccatctgccagcatcacaccaggggatgggggaagagcccatagggccccattctccctaatgacttactataggcagaaacaacatctaaaaaaggaggagcccattagctctcacccctatttgagcatctatagggaattaattgtcactggggggaaaggaaagatatttttagtggtgtaaccactaagtgtcacaccacttagtgtgtaattggtaagagaccaatgctcttgcaaataagccctcttctaggatcctattataaaaaaaaaaaaaaaacccaccctaataaaatgcaatggtaaacccacaagtgccccagcacacacacacacacacacacacacaccagtaagggaatggctggaatggttggagaacaagagagtagtgagagataactatgataaaagtacattatacccctaacacaaaatatccaggaaatatgggatactgtgaaaagaccaaacctaagaataacaggtatagaaaaaggtgaagaaatccaattcaaaggcacagaaaacatattcaacaaaatcatagaagaaaactttcccaacctaaagaaagacatgccaatgaaaatacaagaagcctacagaacaccaaatagactgaaccaaaaaaaaaaaaaaagtcacctcgccacataataatcaaaacaccaagcatacacaacaaagagaaaatattaagagcagcaaaggaaaaaggtcaagtaacctataaaggcaaactatcagaatcacgacttttccttggaaactctgaaagccagaaggtcctggatcgatattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacagacactgaggaaatccagagaatcatcaggtcatacttcgaaaacctatattcctcaaaattcgaaaatctaaaggaaatggacaatttctggacagatttcgcttaccaaaattaaattaagaacagataaggaacttaaatagacctataacccctaatgaaattgaagcagtcatcagaagtctcccaaccaaaaaaagctcaaggtcagatggcttcagtgcagaattctcccagaaattcaaagtacagctaatatcaattctcctcaaagtattccacacaatagaagcagaagggtcattgccaaactctttttatgaggcttcaataaccttgatacacaagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacccacatacctaggaacacctgatttttgacaaacaatccaaatatatacgctggaacaaagagagcatcttcaacaaatggcgctggcataactggatgcaaacatgtagaagactacccttagactcaagcctttcgccctgcacaaaacttaagtcaaaatggataaaagacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatggtgccagatgccacaagagtaacagaactgtgctgtttttctgggattttgttttttatatatatatatatatatatatatatatatatatatatacacattatacacacatatgaaaatgtcaggtgcatctccctgtaagttggagggtagcctgatctacaatgagtgagtttcagccagagctacaaagagaggctgtctcaaatcaaaatcaaaacccccaaaattaccttagttataatgaaattcattattacattaattaatacatattaatataactgaaaaaaacactgagtgtgacagtacaggagggtcccacattcaaggatggcctggggtacagagcaaaaaacttgcctcaacacaaaggaaaacctacttgttttcagtttctcaatttttctgtgacaaatgcttactagtaggaagaaaaggatgagcattttcttcaaggtaaagaagaattggactaattactcaaccctatttcccctggaccacatttcatcagtaatgaataaaccaagttctgatgagcacaaaagaccatgatcaactctgacagcaaggagactgcgttcaaaatctggttctaccttttgatctcctttaaaatgagacaacagtatatatttgcttatataaatagcatcagatctccctgggataacaagagataccaacagcaatagttgccataaaaacagccaaggaaacagttgaatcaaaccaaaccaagggaaggggtcttcaatgaacacctttctgaatctgaatttttctaagccatgtaacatataatcatcaaaaattaacaactaggtatttcatgctgtcaaggtatcactgttaattgtgtgtgtgtaactatattaggtaacgtctgtaaaaagtcactatcagttggtacagtgcttgcctagcatgaaggaagccctgcttttgattcccagcactgcataaattggacatggtggtatatgcctgtgatctcagcactcaggatgtgatggctggaggatcagctgtccaagatatacagacagttcaaggtcaccatgggctacatgagaccttgaccaagaacacacacacacatgcatgcttgtgtattatatgccaagtgcagtaacacattgcattccattggaggcgccggggatcgaaacagggtttctctgtgtagccttgtctgtcctggaactcactctggagaccaggctggcctccaactcagaaatccgcctgcctctgcctcctaggtgctggcatcaaaggtgtgtaccaccacttcctggcaatgctagtattcttgctactcaggagaacaaggtagaaaagatcaaatgggcacaggctggcccagactgggcagcacagcatgactatctcgaaataagaagtcatcttgtagaacactggaacatataggatttgtctcaaagtaactcaaaagtattggggtgtaacttggttgggagcctatggtaagcacatgtgaggctctgaattcaaccccatcattagcgctccagcgtttctcctcaagaaacaccaaaaaaaaacaacaacaataaaaacccctgtgaagcagggagttaatggaacagaacagaacagaacaggccattggttgagagtcactgaagctgtgtggtaagtaaacagagattataggtgtgttcgctctacatttccaaatgtgaatttcccacaattaaagatttaacagtcaaattcaaaaaatattattaaagaaaattgcttcttttaaaaatgatatttttatgtgtatatgtgtatgcgacccatcgtgcgtagggctcacagatgataaacgaaggcactggatctcctggaactgcatttcaggtggttgggagccaccacgtgggaactgggaactgaacccaggtcctctgtgagagcagtaagtgctcttaaccactgagccatctctccaacctcttaaggaaacttatttaaaaataaattatcttatgattgctactaataatgatagtaatgaagatgctttttaaaaatatcataaatttagtgcccattatagtttgccaaataattttagttcctttttcatactccataaaagagtatttgatttagtattactcagctgttaaaaacaatgacatcatcatgaaatttgctggcaaatggatggtactagaaaagaccatcctgaggaatgcagacccagaaagacaaacacggtatgtactcactcataagtggatattagtagtaagtaaagtaaaggataatcaggctacaattcatggacccagagaagctaaataacaaggagggctcaagggggaacacatgaatgtcactgtgaaggggaatggggagagagagtactggagagacaactggaatggggtggacctctctgggaagagctagaaatctagtgtaatggaaactctcgggaacttatgagggtgaccctaactaagacttttgtcaatgggaaaaacagggcctgaaccagccatctcttgtaaccaggtgagatttctagtggagggattgggaccccaccccagccacaaaacctttgacctataatttgtcctgcctacaagatatgctggggtaaaggtagcacagaaattgtgggcgtggccaaccaatgactgctctagcttgaaaccccaaaccatgagagggagctcacccctgacactggctggagggccaggacctagaggtgggataacccaaagacctaggatagaaccaaacatgactggggggggggtcgtcaatgaaatgactcctaatgatattctgctacactcacagattggcacctagcccagtggtcatcagagaggcttcacccagcaactgatggaaacagatgcagagacccacagccaaacaacaaacagagctctgggaatcctgaggaagagggggaggaaggactgtaggaggcagaggggtcaaggacaccacatggaaacccacagaatcgactaacctggactcttagacactgaacaggcaaccaaggaacctgtatggattgacttaggccttctacatatatgtgacagttgtatagcttggtctggtgcctagtctcactgcaacttgacatggctggttgatatgcatgggaggcctgcccttttctgaagagaaatggatgaggaggagtagattgtggggcaggggggatgggagaagaggaaggggaaactgctgttgtaatgtacaaacaaaaaataaaataaaatgaaaaaaaaacagttaaaagttgactgagttctgaaggtaaagtttagtggtagagtgcttgcctatcatgcatgaagctctggtttcagtcttcagtaccataacacacacacacacacacacacacacacacacacacacacacagagagagagagagagagagagagagagagagagagagagagagagagagagagaaagagagagagagagagaggacctgcatacagctggcccagcaattccatttttaggcacatactcaaagaactgacagtgagtactcaaatacacatgtgttcacagcagcaccactgacaacagtctaaacagcccagatgttcactgatggataaaagggtggatacattgtgatatatacatatcatgaacattacccagccatacaaaggaatgaaataatggcatgccacaatgtcagtgacctcagaaaacatcatgtcaagtaaaaagaaaccatgtacaaaaggtcacatattaaatgatcctgttgatatttgtattcaagataaagccacaggggcagaaaacaggctagaggctggcaggagtctacaggaaggggaacaaggaataattgcttattgtatgtagcatttcattctgggggaggtgggaatgtcatggaacttcatcaaaggtgaagtgtgcagcttataaatatattaaatgccaatgaattattcactcaaaagtggttaattttatgccatatgagtgtgacagttggttttaatgccagcttgtcacaaatgacaatcacccaagggaccctcatctgataaattttcctgattgtcttaactgatatgggaagaccaaccccaaacatggtgtcactttctggcagcagcctggatttaagagcatggcagaggaagatcactgcttccctctcaagaactagttaatatactaccctgttgctgctgctgattccttctaagacaatcagaaccatttactaccctgttgctgctgctggttccttctaagacaatcagaaccaggcatccctcactaacagaggaccagaggcactctaagaatataccaggtttttggcactagattaggactgacagcaactgggctcagacttttatcttaatgtagaacaattacagtgaggaaaaaaacaaaacactttttttttttaaacttatcagcttggctaagtatcaagcaattcaagaacagcctgcactggataaggtgcaaagacagcaagtggcaggactagcaattgtcctgcaggtttaatccatcagagtataaaattcaaataccgagcccattgcaccctattattcaagagttatttgtagaaacaaagacctgaaataaaccaaatttgtatcaacaggatattgggataaattataatatgcttacatatggaatattatctatttgtaaatggaactgtccaacttttttgtttgttgtttttttgtttttgtttttgtttttcaagacagggtttctctgtattgttttggagcctgtcctggaactcgctctatagaccaagctggtctcaaactcacagagatccacctgcctctgcttcccaagtgctgggattaaaggcatgcgccaccaacacccagcagaactgtccaattttatatgtataggaatggaatgctttgtaaagttaattcaaaatagacaggcagaatagaatggtgcctactttatagacttccatttgcacaaactaaagaatttatttttttccctccttgtcccctgccccatgatgaggaatgtgtatgttatctctggaaggagactggcgacagattatcttaacgaaggtggctcaactggagggtagcctagactcacagtgagttcaaggctaccctgggcaaacttgaagagacctttgctgtgaaataatccttgtgtacactgtgtgaatatgtgtggctatgactggtttaataaacaagctgactggccaatagctgaacagggtcaagttgggggaaaaccaaactgtgaatgatgggatgaggaagggtagagtcagaggagacgcctgacaacagcagaggaggcaggatacgtagaaaacgcgataacaagccatgagccatgtggcagagtgtaaattagaaatgtggattaatttaagtgtaagagttagctagtaataagcctgagctatcagatgagcacttacaattaatataagcctctgagtggtaatttggaagcagctgctgggatgggaaaactctgcctacatatcttatctcaaaatgggggctcacccatcatatgcttgcttagtatacacaaggcactgaggtcaaccccatacaccactaaacagacagacattggagtagattagaatcctgtagggttttatttttgtttacatacctcaaatacagtgctctaaatcaaacagcctgagaagcatacagtaagaagttccagcaatgctgccaaacacttctagtaggtaagtactgcacagttctttgtatccttcagtttttatgtatactgcatgtaaacaaatgactgtgtagacttattcatcttccctgtcttacagtaaagtatcccatcctttctacccccactcctcacctacctcaactgctaaggactgaacccagggcctgtgataagcaagcaccctctaccactgagctacagtcctggacccacatttccctttttataatgaatatttttttgtagattttccagtctatagatgtattgccactcttttttttttttttttttttttttttttttttttggaaatggagcctatcctggcactcgctctggagaccaggctggcctcgaactcacagagattcgcctgcttctgcctcccgagtgctgggattaaaggcatgcgccaccaacgcccagctatcaccactctttttaaagctatcccatttttcattatacaaacattctgtaatgaacatgtgggctgttctggtcttctgttaccacaatgcttccatgaaaaaacattaggtatataccatgtctatagaaaggttgaaacatgcactagtaattttaattagatagtgggttttttgaacttctggatccaaaaaaaaaaaaaaaaaaaaaaaaaaaaaaaaaaaaaaaaaacgactaaagctattgaactttgtcctgtaacatataaaaaaaaaaaagacacatataaaatttacatcctccaaatggaccccagaggccctaataactgatgacatatagctattaagagtcaggtgatttaaagggggggctcaactacaatctaggaatgctgagagctctttaccttggttgatttcagctgcagaaggccccaagctcaagctcttcttctgctgagcatttttggcaagaagtgtgtgtttgtcgtcattccctgtgtccatctctgaaatggtgacagccagaatccggcagaagttagcaagctgctgctgatcgaaattggatactaaggaactcagattaggaacttcatctagccgaatcatttcctatagaagacacaaataaacaatccccatgctcagttcctcaagaagctgtgtgtcctccttgtcctcctcctcctcaggactcagcagtgagggccacgtggtctcaaaccccagcactgcagagctcagttgtgcaagctcagttacgatctgggatctctttctttccctgctgtcacacagttatacggaggctacatttaccctgtgagcacaactgtctccactgcctgccttagttctggcagcacattttgttccctttttaaaaacctaccattcaaattttataaatcacactgaaatctatatagaccctccaacaagtggctctagttaattcttttttttttttttaagattttatttattatgtacacgacattctgcttccatgtatatctgcacaccagaagagggcaccagatctcataacggatggttgtgagtcaccatgtggttgctgggaattgaactcaggacctctggaagagcagtcagtgctcttaacctctgagccctctctccagcccccccatttttttttgttttttcaagacagggtttctctgtggctttggaggctgtcctggaactgtctttgtggctgtcttgtagaccaggctggtctcgaactcacagagatctgcctacctctgcctcccaagtgctgggattaaaggcgtgtgccaccaccgcccggctctagttaattctttttttatcgctttactacatggtgtttgctctcctctatgcacacttaggtgaactgtaactcttcattacaactgaacgctgcagtgagcatctccacaggtggtccttgcatacatatacacagcatagagcttaccttcttggctttatcagacacacttccaaagttttaaaattaatgttcgctctaatttttaacaggaacactctatcacgtaaaagaattttccttctattcctagctgtatgatttcaggctcaccacacattcatacatagagaactaggctcatagggaagtgctactggaaggtggaggaacctaaggagatccttaggaaattaggagtaccctgctagaaggtggctccttctgggactcctttgtaaccaagggagacaagtataaaaagcccaagtctggtcccatcccagtctctttgtggctctctcaaactccatgctgctatctgccatgaggggatgcagccactccagttgtgctgtgtgaactttgaagctccagaactgtaagccaaataaacttcattttcttcccaaggagcccatgtcaggtgttttaaaaaaaaaaaaaaaatgcttctttctgggctggagagatggctcagtggttaagagcactggctgctctcccagaggtcccaggatcaattgccagcacccacatggcaattcacaattgtagggagacaccgtaaccatgcctcctaagggctggctacaggtgtgcttgaccacgccctgacaggcatggtcgtgtgtccctacacacaactgtctgtaactccagctccagggaatctatcaccttctgacccctgcaggcactgtatgcagttggtgcacatacatacatacaggcaaagcactatacacataaaataaatgaacaaaatgcttgtttataatctcatgcttccccgtctttaaaatcagtgtgtacacgccatgagcttttcacattttaaaccatcacacattctacagacagcacctgctttctctcaccccactcgtcaacttctactacgctggctatttttctgtctctgaatagaaatgtttatgtgtcctgtatctatttcccaaataatctgacactaggccttgtcttttctttagagccctattgcacagcacctggtggcaaagagctcagtaactacgcactaatcaggcaaatgattcctggacgtggtgatgaaagacagtggtttgttaagaaggaggcctttgggaacagctgtctgtcctctccccagtcaggcacacggatgtcagctactactgttaccagcaggtactctttcagtgcctccagtcccccagcccatctaactcagtgtgtgactcttggcttctccatccttctagccctgtccaactcagggtgtaaccaggtttcaccaccccacacccactttttattgttgttggttatgagatggggtatctcactgtaagttgggcttgtttaaaactcatgctgtagcttaggctggacttagacttgcagtaatccccctgcctcggactccctagaataaaggttacattacactcagcttcactaacttttaatatttgacacgttataaagcataatgggctttttcactgtgtgagccgctgtcaggtgagcactgctattaattactttgtcattaagaagttttacattttagctttctgaaaacggcaagcagcctacagtactttgtagctggcttgatccctcagtcacttctctattcagctgtgttttaacccacagcaccagtcatgtctaacactttatgatactcggtctgtgaggagatatgggtcatgggcttacttttagtcttctactctcaaacagtgctaccctaagtactgttgcttgatgcccatggagaagttttcctagggcagtagccactgaagaattctgaacaatgacaaatgttttccatcacaagccaataaaatgttggggaaagaacatcttcaaacaatatccttgcatgacacacttgaatgtgtcccatgtagctgacagacagaccttctgggtctcctctagtgttctcatttctttttgtgaatgtatgtgcacacatgttcacatgtgtgtacaagtgtgtatgacacatgtggtggccagaggctgatgtcagggatcttactagatttcagtctcttgtttattgaaacatgacacttgcctatttgccttgctgagctagccagcttgcccagggtcccttgcctatgctttgtacaagtagggaccaccctgactgaccacttggtttttatgtgggagtcggagattcaaactccagttctcacacttgcacagcaagtgttttatccagcaagccatttccctagtccctagtatttgcacttctttaaaatgtttttctaattacattttattaattgtgtgtgtgtgtgtaggtagatatgcatgtgtgtatatgaatgtgtgtgcatgagtatgtatttgcatatgtgtgtatatgtatatggtatgtgtgtatatatttatgggtaggggtgcgtgggcgcgcgcactgtagttggatttttctttgggccaccagttcacaaataatgacatggagtcttatgaaagtttagccttagttcaggcttggttggtggggcttttttttttttttttcttcttgagacagagtttctctgtgtagctttgaagcctgtcctggcactcgctctgtagaccaggctgacctcaaacttacagagatccacctatctctgcctcccgagtactgggattaaaggtgtgagccatcaccacctggctttaggcaagtttttaactagctcttataacttaaattaaccatttctattaatctactttttgtcatgtattgcctatactgcttcctgtgtctccttgccccccccccccacacacacacacaagactagattcttccttctacttcctctctctgcctggaagtcccgcctataccttctgcctagttattggcacttcagctttttattacaccaatcatagcaatgcaccttcacacagtgtacaaatatcccacaacagtgtgcatgtgtgtatgtgttatgtgtatgtatgtgtgggattaaatgcatgtgccaccaccgcccagctaatcttttgtttgctgcatgaattgcaggtaccttttcgaagccagtggttcaagtttccactttagttttacacattacatcaaggcacccatacaatgtagtagaccctatcaccaatttagatagataacacaaataggcacaagaaggcatgagggaccaggtgggcaaagctgggaaggagcaatcactgtctcctactctgagaaggccaaggagcaagcagctcctgcattggcagccattctcacacactggattgatcacacgattcttggaaaataacaaaggcactttgtcaaagagcacaaagggactgtctggggcctgtacacactgagaatgtgttccacagacaatgggccacttgagattttctgtttgggtaataacaggcaaggtctgcagaaagcagaagtaaaagctgggtgacagtgtgtgtaggtactctattttctgcaacaacaacctcaaggagactatacagcaataaaaagaaatccaccaaccagcaacagtgaggcgtggataggattgaggaggtaaactccaggtcctaacaaccactataccaaaattccaacatagtgtatatgggtatatttttggaagtttatgtgtttctgatgagaaaactttaatgttttcatctttttgttgctgtttttagagacaaagtctcactatcatccagataacctcaaacatgtgatgcactacacacaggataatagttcagttgtagaacacttgccttaaatgtgcaagaccctaaataccactaaaaaaaaaaaaaagaagaagaagaagaagccaggtagtggtggtgcacacctttagtcccaacacttgggaagcagaggcaggaggatctctgtgagtttgagactaccctagtctacacagcaagttccaggacagccaaggctacacacagagcaatcctgtctcaaaaccaaaacaaacaaacaaaaaaccaaaaaccctcagcaaaatacaaactaaaaaagaaagcaaaaagaaaggcagggtttcagtgcttatgttcaaggcaattaaccaactataacagaagactgataggaaaataaaaaggtagattaaaaaagcaaaggccactaagagaaacatacatggatctgcctaggaaggaaaacagacaagatctcctgagtaaattgggagcatggggggcaggggagagggtggaagaggaaaggggagggaaggggagtagggggaaatggacagcttaataagaaaaaaaaaaggtaagaaattgaattgtaataaagatttttaaaagttaaaaaaaaaaaggcaaggcaaaggccaaacattgccaccagagagaacaaaactagtgaataaaagcttcacagatagctgctgtgtgagcagtcaccagtgcacacaacagaaaagctgctcaaaagaactcgtaccatgaaagcgagaagcaattttatcttagcaaggaacactaaaaattcaccaaatcaacgtgaaattttgtgttttatactgtttgacttcaatttatatatgtatttatgtttcacagccataaagacccatgggcataaggaatacaacctaattttatatctgaatctatctaagaataaagaatttaacattggggtatggaagagcttcttttaaaggatctctgtccagtcgttaaccaagctcaacaatccagtaccttcgacacactcccacagcgggagaacacagctcacctttttaacacccaaaatatcttcgatgagtgttgctgtttgtaagaacgtcttcttacttgtcatcagtgtaaacaggaagatcacaaaatcatttttctctgccaaacgttttgttactccttccgtctgtcatagggagaaggcagaaaaggcagaattcttgtgaccacaacacaaaacacaaatagcaaagcactattccagatgcagaaagcaatcccatcctgaaaaactagcatgagccaacaaatataggaagttgcatataccgtgaggaaaacgtgaaaaaaaaaggactcctggcactcagaccacagaacagggagactactttggagctaggaatgagaaaaaaagcagggaaaaaaaaaaaaacagcttcacctagctcatgaagtctaagctcataaggctccatttggagagccaacctgtatcatctggacaaaagcccattgactaatgtgagccatcccacccagagcatccaagctacatgcttatgactcgtgaggcgatgacgcttcataagagggtcaaaactaaattcgaattctatctaggtgaccctgagcaaatcttttctcacctttggatctccatttcttcacctgtacaggattctctcaagagcttgggaggattccaacgagagagcgcagtaaacactctcatttaaccgttatcttgaagtcaaagtgatcttggtgcaaccaacatgcttagtttcctttgctatccattaactcacttttctgactgacactcaaaggtcgttcaaacgggtgcacacacagtatctgtgagggacaatcaatcccccagaggcagcctcactcagggcagcctgtcagcagcctcactcagggcagcctgtcagcacttctactacactcttcttcccttgaagcacacactacccaccaagtccccatctgtcacaaccatttagaacacaggaacaagatgagtgtctgctggtagagaacatataaatcaagtatgctttgcctatattatgggacataccatcaggaaaataatgtagctattctttttgccttttgcagaataaaaaagcttgccatgaaatgtggcttctacaaatagcaacatacagaagtctgagattatttgtagaagattgctggtagttgtttaatctgcttaatggatctcatgggatttacactctgcatctcatctatggttgtcattttctttagtcaagaatatgctttggggccagcaaaacatcttgatgggtaaaggcacttgccaccaaagttttctgacttctacacatacatacactaacaaaagtatgtatatatatgcatatataataaattacatatgctattattcataaattgttgtcaaagatgggaacaggccagcaatgtaccaagtcctccacaggattccctctctgtggagtctcccctaaccactctacacacaggcacgcttcttcctctgaagcctcaccctagtctacagcgatccacaccctccaccgaaggggacctccatccatccctgagtgatgtcacagaggtgttctagcttcacacctctgctctctacagcagacctagctcatgagacttaaagactagaataaaaaacaaggggtaatgaaggaataaaaaaaggactagctggcaaataacctcagaagtcatgttcaagagtttggattttaaactggtgagtgggtactccaagctaagagaaactcataatcggtgaggtaaacttgacaagtgaacttaatcttcaaaatgaagagactggtaaaaatgcgccgagtctctcaatggcctagaattcagcaagtcatctaggtgggctggccagtgaggcctaggaacccacttgtctgcctctcagcactatgattacaggcattcgacaccacacttctttgtcatgtgggatcaaattgagggccttaagcttgtgtgcgaaacactttatcagatgagccgagccatctctgtaaccttaagtttttaaagagcaactgttttattagaatgtctccaattaataattaggttacaatctaaaaacacccttgtagtaaacttgacaattactgagtcactctctttcatgctgtcttttttttttttaatattattgaactttagctgtaaaaagttgagcatttttgacaattagccttttgtcttatagatcttcctgtgctgttctgtgctaccagctgtaacaacatgagcacctgaaaagcagctaatccaaacaggcacacacactccatgtgaaacacactggatcctgaaagctcgatacaaaaaaagtaaaatgtctttaaaaactattggaatgataatatttttatgagatgtgttaaataaaatataattatcaaaataattattctcttatttcaaaatagtggctctaagaaaatgtacaataaccacacagcttgcattataatctatggcacgtggccatcacagataccagtgacagttcgctctctgtgctgctggccactaagaagctggaaccacctatgagacactcacgactatgaccggcattttctgtccgcccagtttctgtgcattatgtacccaccctttattatccctccctttcgtatctacttctccatctgtggtcttagtagtattcccctgcaatcttccttagaataagacaagaaacagttaaatgtttcttttgcttccacaacagaggtttcacttctacagcatcacttagcttgttctaccatgcactgtgacaagtaagtttactgtaagttcctaaagtcagcactttgcctttaaaaaccaacatttacacactgctttcaaagtatgttcacactgtgatctcacttagttctcacaaacactctgtggaccaagctcagggagctgtattaagccaacagccagggtacaaaaatcaacttccaacagtaagtgcttagctcttttctttcttccaaattgcttccttttttcaccattcctcttgacacagtggtcaaccccacagactgtcgtattcaataaatgggtaggaccactggcttttgttttccagtataaatgaaagaaacaggcaaaatggagctaaaggttatcttaaaggacatggacactctgccaatacttgtcacccttcagcaagtaatagcctcggcttggatatccgaggagatgggggctggctggctatggagtttggaacctgttgaaatagctttagctctaatcaagtgctacaaaaattctctctccattatttctacctgctggtcctgattctcaggcacacagaacataagggcaattcccttacatatctgaagacagttcttatgtctgccaccccacacaaacattctgcctcactcgtgaagataaaggcagaaatacacagacactaacagcagaaatactcacacagacacaggtattgtacaggatgctcaagcagtccttcgacatctcgtcactcactgaaagggaaggaggagtgttatttctctctctcacaaaaaaaacacaatgcaacgctagcacacactggaacataagacatgttctagctgggcgtgctgcctgcctgcagtcccagcactggagaggcgagtgctgcgcaggcacttagactacgccactttaagtgaacacacgagcacctcaccacactgcagtgccaccagaaaaaagactcaaggtatattttcagcatcagaacaactacagtccagagtgtcagaagcctgaccaaattttctcagtatattcccattgaaaatctgctagcagaaaataagggcatcatttcttcctcagacttaccagctggattttagggtttcttgttgttacagttatttatattaggaaagtggcttctaatgtctgatatactgtcaattccaataaaggaagaactcactatttatctatgaccagaacaagacagtagcacaaaaaggaacttacttttatgagccccaaacccagagatgataaaactgagtatgagccatggtagagtgctttatctggtgttgcacttatttttaaaaaccaatttccattcatttcctcacagccataaactctaacatccacatctcccatgaggtcccaatgagtggccctggaaggctagcatggctggacagatgggtcactaatctccttttgactatgtaggtatgtggtgtgtcttattactatctctctacctatttgacagatttttgccttgcatatttatttaatgaattcagagtagaacgaattaaaatattttagtagttctcaactttccctttccaaagggagttagattcatgcattcattaggaatttgttcactaattttaatgtggtgttgcaagcaaaagaggaagagaagtcccactcctcatggtacctacaaatctattgggagggggagaaaacaaaagtgaccaacaagccattaaatcagtgaatctcagccagtgggtcacaaccctgggatggggggagtcgaatgaccctttcacaggggttgcacatcagatatttaaattactatccaattcataacagcagcataattacagttatgaagtaacaatgagccgagcagtggtggcgcacacctttaatcccagtgcttgggaggcagaggcagacagatctctgtgagttggaggccagcctggtctacagagcaagttctagggcagctagggccgttacacagagaaaccctgtctcaaaaaaacctaagtaagtaaataaattaaataaaatgaagtagcaatgaaataattttatggttggcatcaccacaacatgaggaactgtattaaagggttgcagcgttaggaaagttgagagccactgtattaaaagatgctacttgcctccagagtagaaaagtgagacattcaaaaggagcaagagaacaggacatggtgacacaagcctgtaacatcggtacttggacagtggagctccaagtacagtgggtcaggaaattaaggtcattcccagccagcctgcctcacccctgccccaacaaaaaagaatatgaattctctggccactactggagtctcacacagtagtacatcatattgatgtaggtgcaaatttaaaatgtttctatttattacacattcatgcatggattttttttgtttttgttttgttttttgtttttgtttttttcgtgacagggtttttctgtggctttggaggctgtcctggaactagctcttgtagaccaggctggtctcgaactcacagagatcagcttgtctctgcctcccgagtgctaagattaaaggcgtgtgccgccaccgcccggcttatgcatggatgttaactgtagtgatctcaggcttttaaaggcagagtgaagtgtacctttaaggtagaatttttaataattaaatactgaaacctaaaaaagaatgcatgtcacacatgtaagttgcaaaaataatacaacaactaaacctatcacccaacctaaaaaattatgaattatataaacactgactttttgccatgtatgactctggcaatggctgaacttttttcttattcattcattcattcactcattcattcattcacttatttagaagcaggttctctctttgtggccctagctgtcctggaacttactctgtagatcacactggtatcaaattcagagatctgcctgcctctgcctcagaggttgggattagaggtgttgcaccaccacatccaacatgactgaactttttacaagagcataaatctcctttataacaaaaatctgatgggttgatgggctgtttaaacaaaatgatcttaccaggcaatgtattagtttctcagaaaacatgtaacaaaaaaatttctaaagaaaacaaaagctggatcaagtcactattagaaagtacaaagatacaacttttttcaaaccagtggttttcatgttctttcttttaaggtaccaagtcttcatttctaacaaatatacaattgatgcagcatgttgctgagcttgggatggatggagcaagctctagggctgacaactggatatgctctcatgtctcaaagaagagagcagctcctgccgatggccaccacacctgacacattgggacaaggaccagaacctaacaaacatacttactttttagtttctgtccccggatagagatcgtaggcctcataagaatttctacaagaagctgaaaacaaaaaaaattaaagatcttcaaatttaattcaaagcacaactcaaaaaacagtttttattacaaacacttgtggtccaaggacctatcacaaaccttcttgttcaaaagaagcactttagctagagctagacccctcgagggccaggagagggcactggatcctctgacaccaaaggtatagaagctgtgatttgccatttgagtgctgggcacagaatctgagtcctctgcaagagctaagaaacactccacctctgagtcatctctccagcccctaaagaacatctcttattcttataacaagggctttcatttgtgaagttgcttcctatttcagtatttctgttatttctgagacacagtctatctgagtggcccacactaacctccagctcatgatccttcagcttcagcctttcaagtactgggattacaagtgttcacctccagcccactttctacttaaacatattaaaatattttaaaataatctctgtgctaacagaacagctaagtctatgtatttaaagacattaaccataagtaggtattttgttgtttaagtcaaatcaggaatagttttgaaacagaatccaaatgctctcttaaccctttccagctacaagccactactggacagcacagcagagacacctcaagccaactgggggaaaaagatcccacaacatttttaaagtttctgtttcttctcattgtttttaacaccaacaggcagcctttaagattagcgatcagctgagggatcatctcagaccagcaacaaatcttaagaaatccaatccatcctaacgactttgggtgctgagtgactcccacgtgcagaactgagggcagaggctttggcatgagacagtagctgacaaaatgaaaaccctcagcacctgtaccagactcacttctggagactcacagggcttggctttctgcacaaccacattaaaagctaactgcactggtaggagatgagaggacttgggcaaaccacaaaaggcgctctgaaggcagccttctgctctgtgtggcagagtggtaggttgtgcctacctactactaccctgcctccagccctcatgtcatacagtttaaagtttaataatcagttgtgtgtggggggcggtgcacaggtgccctggcatctctggaagtcagaggacaacttgtggtaattagttctcttcttcactctgcaggccctccatcagcctacacttttcacaagagatcacaatccctgagctctcaagatgtaagatgctcagatgcaccaagtattttacctcaataagctcagtgagaatacaagctaggtcaatgagtaagaggccctgaatgccaagcaggaccacatctgaccctcaggcatgcttcatttgacacatacccaggattcctaatgctcctgctaagggtccagctttgtatggattctagggactcaaactcaggtcttcaagctttctagggcaaatgatttttacccactgagccatctccctagcctccgacacacttttctttgttttttttttgtttttgtttttgtttttttttgtttcaatgtgtatgagtattctgcctgaatgtacactgcacccatgcagtactcatcgaggccagaagaggtactggaatccctggaaccagagttatagatggttatgagtgactatgtaggtttcagaatcgatcttggatcatctcgaagagtaatcacaacttctgaactacttcttcagctcttcctatatacatttcttgataagcaatttaaaagtagagggtatgagtgtaaaagctaccggatcacaataactggctaacagggaatgctgagcaacaatgaagaacaaagggggactgggagtaggagtgttggtggtagagctcttgcctagcatatgcaagggttcggttctatcaggatggagggagaaaggatgggaatgggaaggccaggcacgataaagacgggacactcactctttagtttgcaatggatgccattgtaaccaggcatggtggcacagggttagaaccatacttgggaagcaggaggattgaaaacccaaggcctgcttaggttacagagctagtgcaagaccaatctgagtaactaaatgagacactgtctcagggataaacaagaagaaaatggcactttttaaaggcaaaattttaagttaggagagtcatacatacctataaccagtacttagaaggtagaggcaagaagatcagtgagtcaaagccatcctcagctatacagcaagttggagactaacttgggcaataggtgaccttgtcttaaaaatccaaaaatagctgggcagtggtggcacacacctttaatcccagcacttgagaggcagaggcaggcggatctctgtgagttcgagatcagactggtcagagcgagtgctgggaggcctccaaaaccacagagaaaccctgtctcaaaaaaacaaacaaacaaacaaacaaaaatccaaaaataaaggaacccaactcccccccaccaaaagacctaagtttgattctaggcactcacatggcagctcattaactatctgtaactcccattccaagggaccagaaatactactatggcccccaaaggtactggacacccatgaggtgcgcttacacatatgtaggcattcacacatacacataagttttaatgaagtaataagtaaatgaatgggctgacaaccaaactaaaaagacaaaacagctattaacagataattgataagaaaaggaattacttacaaacacatgaacatatccaatctcactcacacaaggatacacatttttattactattaatattattttgtttttgtttttttgagacagggtttctctatgtagcaaccctgactgtcctgaaattttctctgtagaccaggctggccttgaactcaagagatctgcctgcttctgcctcctaagtgctgggattaaaggtgtgagccaccatgcctggcttattattattataatactactattattattttggttttttgatacagggtttcgttaggtagccttggctgttctggaactagctctgtagaccaggctgtctccaattcacggagacatctgcctgctgctgcttcccaagtgctggattaaaggctcgtgccaccaccattcagctaaaaaaaatttaaaactatggagaaaatacataaagaactttacatcttaataataaaaaagagaaaacccaatttgaaaatgaaaacaggagatgacagtccttgaaagacttgtcaacatcatcggccatcagcaaaatggaaatccaagtcacagtgaagcatttcactatcactagaataggggtaatagaaatgacagatgataaaagtattggtaaaaacaaaagagaaacctgaattttacacacagctgacaggagtatgaattagtgcagcctctttggaaaacagtcaaccagttccctcaaataattataccaagttaccatgtgacccagcaatttcacttctaagtgcatacccaagagaaaggaaagcacctatctacacagaaacattcaagagtgttataagcagtactcttcattacagtcaattgtccatcaacaggcatagacacataaaatgtgctacacagccatacagtggaatatcattatttggctacacaaaaaggagtatttatgcatgcttcacatggatgaagcatgaaagcactgtgctatgtccaagaagccaatcataaaagaccattggatacataattccacttacaggaaatacccagaacagcaactatactgtcaaaagggagaccaatggtcgccgtggcggcagggaagtaacttctttggggcatgatgaaaatattctaaaactgactgtaacgatgcctctgaatacaatgaactgtacatactacactcaaccttagccaagaagtgaagaaataatcaactatatactttaaaagggttatggcacctgagccatagctcaataaacccagtttaaaaaaaaaaaaaaaaactgaaaagaaatgtatttttttctttttcttttcctgtatctgcttagtaaagacttgaaacacatagggaaaagggctcctaggtgctggcatgggctctttctttatttgagcagcaggacaaagaggaacttattttgtggtaattaccagtgtgctcttctgtatcaaggctagacttttgtaatatgatgctcttgcagaggacccaagttggattctcagcatctatggtgtagctcacaaccatccactactccagttctagggtcttccaccctctttctgctgctgcaggcaacacacatggtgcacagaaactcatgcaggcacacacattaccacataacacatataaataaaaacaaataaaacctcaaaaaatacacagaagggaaaaatgatataatttcaaaataaaagaaataattcctaaaaatacagatatatacagcatgtgtatgatgatatgggtaaaaagatactcttacactttgttcctggaatttaaactgataaaagttagtgtaaactgcagattaataaataaaagacatacaagctttggctccaaaagtccataaaaaaatcttctgcaatcttgtttgtaataaaaaaaaaaatgtggccaggcgttggtggcacaggcctttaatcccagaactcgggaggcagaggcaggcaaatctctgtgagttcgaggccagcatggtctccagagcgagtgccaggataggctccaaagctacacagagaaaccctgtctctaaaaacaaaacaaacaaacaaaaaaaatggaaaaactaaatgttcaacctgggcctcagcaaatgaaccatgatacaatttataccaggaaatattagttggatatttaaaatgccagatttaggtgtacagaaatgaaactgtacccacttagtaagttacatggaaaaaaacaaagcataagagaccaaactggatatacgacctggcagtgcatggggggagaaaagaaactaagttggagataggtccttcagcccttcagtcccaaataaacacacggaggcttatattaattaaaagctgtttggcctattactcaggcttcttactaacaacaaactcttacaactcaaattaacccacaatccttatctacgtttagccaaatggcttggtaccttttctcagtatggtggtctcatcttgcttcctctgcgtctggctggtgactgtgcctctgcctttcctctttccagagttgtcctagtctggtcaccccacctggctactggccaatcagtgttttattaaaccaatactagtgacagatctttacagtgtacaagagcattagcccacatcacgtttgcacatgcatgtggacacaaacaagagcatctctgggacacgtgagaaactagtaattacaatagcgagacacactatagtgattcaacaaaagaaaatgccattcatctcaaagttaaaatccagaccagagagaaggcacagcagagtaaggcacaggtgacaagcctgatgaccttggtttaatccacaggacccacatggtggaaaacacacacacacacacacacacactaaatttgaaatgtttgctataaaatctgaaattctttatgcctcccattttaattctcacatgattaaagtattaatagtattaaacagctacttacatcaacacctccaaacaagtcaaaaatatatgtattaggatacgtagcttcttgagtaagtttcctatcttcagttacaaatgccatagcctccatggagagaagaggggaaatctcctggttcaaaaaagtacagattccgctttagaatttaacacagactagaaacatccaaatatctaaaataccactaaaatatgcattttagctgcaaactgaaaccccctgagcacaaagctaggcctcaatgaagcattagggacccctagaatccttttcccatggaatctggctagtgtgactgatgtcaacgaacagaatgtagagaagtgacaccgcacacttagacataagccttacaaaggccaagcagagttggctactgtagaacctcactgtcatgttgtgagcagccccctggggaaggccaggccatgcatgcatccttagctgacttccagcagcaacacaccaggcaccagtgaggccatcgtggaattctgcacatctttaggccctacagtaaatacacaggaagcagaagaacttctggctaagagaagatggtgattaccacttgaagttactagatttcacaagaaacagctggttctacagccaaataaccaaatctctgctggactgtgacctcctgaaggaagtcctcagtgacttctccaagtcaaaggcattctgacagtcttccacgaccacccaaaggaatctctaagtcatttgtgacatttagcactttactttgcaactatttacaaacctagggttttcttcccttgaagacaagctccaacagattcttgtttgtttcctcctctaagtctcaaggcagaggaggtgttcagcatggtaggtactcaaaatttgggaggggcccagcatcctttgttcataaaacatacgtaacagacagaaaaacctcacagcatgctgccttacacagtgtttttcaagtatgtatttacaggatgaagaaagtcaagatcatacaccatggtcacctgagtactaatttcccaagccttcaattttacctcaattctgtaatttagagatttggcaggaattaaatgtaacaaattttttggaaaccacatttagtttttttgtcttgtactgagagacaggatctcactgtgtagccctgactgtcctggaatcatgtaataaatgatggccttgtacttatgggggctctacctgcctttggcctcccaaatgctgggagtgagtatgtaggcaccacacccaacttggaaagcattttaaggcacatatagaggagctataattacttctatcaaccagactgtgaaaagatgaagaatatgtaatatctcttcataaagggaaaaactaggctgatttaataaggatgtttagaatacacctggacagtcattaacattttacctctgaagagtactgcagtattcagttttattatgaccacaggcttacacaggttgtaactgtagctccagctacttctctaaattcctgtttggacacagcccccaagtcagaaactttgagtgtgggtagcattgagacacactcaagatggagaacaagtatctacaccaatgtcattgtactcgaaacctaaccagcaatcctaacttcaatccaacattagtgataattaccaacagccagaaagccccttccaagagccttcagtgatatgggtcatctaaggttagggattggggtaggggttcagagtgtacaattctaacctagcatgtgcaaggccctaggctcagtccccagcaccacaggatgtgggagtgaggacacagtgcagacttcccacactgctttaacagcttccacagaccaacacacaccttgattggctctggagatggaataactaacaaatattttgtttttcaatgcttctgctgaacttctccaattttctacagctcacaaaaaaactggctgtttttaaaaggccaaccatttgaggatgtggagacctgagcacaaccttctaaggcctttctgagttaccttgaggatgttttggcactcaatgaagtcactgtggaggtggctggtggcatgcagcttaaggagcaactgaggaattccactccatttggacaatttgtccctctccgtcaaaaaggtctcagtgaactgtgaatttaaaaaacaaataaaaacaaacattttactggcaaggaagtagttttggcaaaagagagcagctgattcccaaaggcccaggaagataattttttgtttgtttgtttgtttgtttgtttgtttgtttcaagacagggtttctctgtgtaacagccagggagacaatttaaaagtggctctgaagaactcttacaagccgaagcctaagccctctgctccagatacagcaccattctgactccacccttactcaccagcttcatgcttttcccagtgcacactcaagcctccaaattcagctgtgttctctgcccacaggctctctcccagtctttactgtctgaaatgcttgttttccttcaaatgccaaacaatgagggccagggagatgacccagtgggtaaggctgctcgctatactagctgataactttgattcctagaacctacataaaggtggaggaagggatttatcaacaccatacactgtcccctaacccccaacatgcacatcacagcacaggggtgcacacacatatttaataaaataattaaaaattaaggaaacttttatttaaattttaagttactatttattttatgtgtgcgggtgttgtgcctggtacccatgcaggccagaagagggcatcagatcccttagaacaagtctacacagtgagttccaggtcagcctggactgtagaaaccctgcctcaaaacaaaacaatacataacaaataattagatacaaaaagaaatcatgagctgggcattggtggcgcacacctttaatcccagcactcgggaggcaaaggcaggcggatctctgtgagttcgaggccagcctggtctccagagcgagtgccaggatagactccaaagctacacagagaaaccctgtcttgaaaacccaaaaaaaaaaaaaaaaaaaaaaaagaaaagaaatcatggcaggagttggatagaggttaagagcacttcttactcttacagaagacccaagttcagttcccagcacacatgctcggcagttcacagctgtttataactccagttccggcctctgccggcatgcacacacatgtggcatacattcacatacatacatacatacatacatacatacatgcatgcatttttagtgcaggcaacagctagaaaccttccttggttggccctccttcctctccttcctagggcagtggcccctaattaggggcttcacctattatatagtttaacctattgtacatagttcccaattcattggagccgttctttctctggatcactacttcagagcagataccaaactgtgaaaacactcactcactcttacttttattcaacttgcacagagtaaggactcaataaatgtctgaaggctctggggcagtggtggcacacacctttaatcctagcactcctgaggcagaggcaggaggatctctgagttccaggccagcctggtctatagagcaagttccataacaggcagggctacacagagaaaccctgtctgaaaaacaacaacaacaaaagtttgaaggcatcaacaaaagcaacagcacaatgacagaacatgagtagattatgaagattttcactaacatgttactattacaaggaccagacaggaaatttttgtggttcaatcaaattaaaagatcttgttatggtttgtgctgagcaaacagaccttaaatgtttgggttaatatgaacaggaatgccctgtgagatggacaagtctcataattctttctacatttgtgtcttagagattatagcatgagggataacagaaaatgttcaaaagaatactttgtcttagggtgaaacacagaaaaatactacttcttacaacaaaaatatctgtatattagcaattttatagtgctcaagctcaaaatcaatatgtggtgatatattgtttatgatctaataaaggttgcctgaagatcagaatgcaaagctagccacagtcatttaggccaagcagtggtggtacacacctttaaatccctgcagccatactagtcacagaggttgggcagtggtggtgtatgcctttaactccagcactagagaggtatacaagacaggagctcagggtctcattctgtattcagtctgatgctgaggatttgtaaagccaggatcaccctttcagtctgaggtaaaggtaagagtggctggctgctttgcttttctgatcttcaggcaagcttcattatttattgattgattgattgattgattgattgattttttgagacagggtttctctgtgtagctttgtagaccaggccagtcttgaactcacagagattcacctgcctctgcctcctgagtgctggggttaaaggcgttcaccaccaccgccaagccaggcaagctttattagatcataaacaatatatcaccatacaatacaagcttctttaaaaaaagtttagaaccccctttcttttccttgagaagcaaagcaagcacctacagcttcaagacctgcagaagccatccctacaggatactatgtgagcactatgacactagagggctttaaacctgctgataacccaccatgagaaactagggaaataaaacaaacaaccccctccaagaaaaaacaaaaactgaacagagatgggggaagtgcttctgtgtatgtgtttgtcttactggataataaataaagtactgtttggccaatgaggcagcaagttaggcgggactagggatcaaggaggattctgggaaatgtagtaaagaagtggtgatccacgtgggaagtgacatagcagggagattcctaaaacaagggcaagaaggaagtggacccccttctctcttcctcctgggctctgctctggagtcaccatgtgactggcaagagcggaaggcatcctctataagataagtcttataaaatatacagatttatgataattaagagtgagctaccagatgagaaatcctagtcattggccaagcagtatttgtacctaatacaagtctctatgtattatttggggtcctaacacggcgggcagatctcgggcggctggcagaaagcacccacatggcgatagggctccggtggcttttgggcagaaagatttatcataacaaaacagggcagcagaagtaaagtaaattaaaagcaggaaactacacaaacatcaacaaaactaaaagtttcaagattttttgacaagaccaattaatgcacaaacttttaactgcagctactaatgcctggctaaaattattgaattcaggaatgaatgagagaatattactgccagccttaccagagcagaagagagtatagtagagcactgtaaatgaccatatgtctacaaatgaccatttcctaaaggaaatgactaggagaacacaaactgtgaaacaaagtatcaagcagacctacaacacccagcagagaagtggcattaaagatgagtcacacagcaatggccaacacctccagaggagagtcctggcccagatcaatggaccaaacattgaaaggagcattaacacaaatactcagattcccacaaaataggtgaggccagaattctggtaacaagtctagacaaatacagaagaaaactacaggtcacacttaccaatatagatgaaaaaacctagcaacacatatggcaaaagcaaacaggattgatttatcctgggaaggaaaatagttcaacatatcaactttaaaaaaccaacagactacaggacacgctcaggatatatcaaaagacagatgaaaaatggcaaaagccaaacacgttttcatgattaatactctgcacaaattagaaacagaacggaactttctcaaccagctaaaggcatttataaagagtctaaaattaacatcaagcttattagtaaagactaatgttttcctactaagatcaagaagaaaagaagactcaaagatgtctgcttttaccacttccatttgactatgtagtagaaacacgaatgtgaacaattagacaggaaaaacaaagagcattgaattggaaatatggaatactctattcacagatacaatgggatcctgattatcagttacatttatagtagtatcaaaaataagatgtttaagaataaatttaacaaaagcagtttaagacttatacaaggaaactaaacactattaagatagtaaaggacacccaggacactgaggcaggagaatgtcaagttcaaggacaggctgagttatacagtgagaacgaaaaaaaaaaaaaaaaaaaaaaaaaaaaaaaaaaaaaaaaaagacaaggaaagatatctcatgtttaagggatgggaatttactgaagtggccataccttccacactgcttactgttactaaagcaacaatacccctgcactgttgacttaatgtaattcctatcatggcctagttgtcttcattgtagtaacataatttactactaaatgtcacacaggaatgccagggacccgtaacggttgaaacagccttaagttggaagaaccataattcctgaatttctgatttgtaactttatcacatgtctacattaatcaagattgtacaagctaggtgatcatgttagaccattggaatagcaatgagattccctaatggttaatcaatatttgttttggggttgatttgtttgtttgttttggttaggtttgtgtagtcctgactggcctgaaactcactatgtaaaacagtttggcctcaaattcacagacatctgcccatctctgccttctgatggctgggatttaaagacgtgtgtgtcaccatgtcctgaggttaattggtttttcgacaagactatcaaaaccacagaacagttttctcaacaaatgatactagtacaagtgaatatctctaagcaaaaaaaaaaaaaaaaagactccttgggactggagagatggctcagtggttaagagcactggtgtaggggaagctggatacctctctcagatgactttagggtttagttaacatagatagttaggatgtgacataaacagattgttgtatcttcttatattttacctgtatgattgtttattttggatactttaaactgttaagttttaatcctcttttagattaaaaggggaattgtaggggaagctgtagccacgcctacttaggggctggctacaggtgtgcctgaccacgcttgtgagggcgtggtcagagtgacgtaggggactgcgtttgcacttttggtttctctttgcttcttgctgtacaggctgctgccacgacagctggctaggtcgttctgtaagtaaggcttttccctattaaatacccttatatttctacctgactccgtattggtaatttcccactatacactggctgctcctccagaggacagggttcaattcccagcacccacatggcagctcacagctgtctgtaactccaggattcacttccctcacacagacttacatgcaagcaaaacaccagtgcacacaaaataaaactaaataatttttaaaaaatgactcccgtgcctggcgttggtggcacatgcctttaatcccagcactcgggaggcagaggcaggcggattgctgtgagttcgaggccagcctggtctccagagtgagtaccaggataggctccaaagctacccagagaaaccctgtctcgaaaaaccaaaaagactcccttatagtatatttaaaaattgacaaaatgagtcaaaggacttggagagggcacttagctggtaaatgcttacaagtatgagggtgtgagttcaatctcagaacctatgtttaaagggggggggggtgtggtaggcacacttgtaatcccagggctggggagttggagacaaagattccctgagacaagcctacccagagaggtccattcagtgagagaccctgtctccaaaaccaaggaaaagggcacccaagacacaacacctgaggttgtcctctcattaactaatacacacatgtccactgcacctgagcatatatacacaggcacatgcatgcatgtgtaaacacacacacacacacacacacacacacacacacacaagaagagaaaaattgttacattaggcatactgtctgaagacatacagaaaaaacagaataaaatatttaaaacatggatggaaaggggggttaaaaaaaaatcacacctactggcaacactggattcagtgaggttatccttgaaaagaaaaatatgaatcttctctgacaaaacttgatctttcttaccagtaatatgagaggtagttagctctttttgtttgtttttgttttgtttttcaagacagggtttctctgtagttttgtagctcttcctggaactagctttgtagaccaggctggccttgaactcacagagatccgcctgtctctgcctcccgagtgctgggattaaagtggtgccccacggccgcccagctgagaggtagctctttagtgacaaggaaactgatgctagtgagaaactgtgggtgtaactaagcatctatgtggctactgtctcttctaatatgtcatttatacactatatacaaagagggctgcttatgaaacaaatgaacataagttaaccttttcaatctaaatgaatagcaacaattattaggtgattacagcatctggagaagtgaactgaatggcagccatcttatgagggtatgagaaggaactgggatacttgttccactcacaaacattggctgactgcaatgaatgatccaaactctagggtaaccaataaaaataaccactattgttgggtggtggtagcaaacaactttaatctcagcacacaaaaggcaggtacaggcagatctttatgagttcaataccagcctggtctacagaacaagttccaggatagccagggccacacagagaaaccctgtcttgaaatcccaaaacaaacaaacaaacaaacaaaatccccactataacttcacacataccctttttgaagcccaggttggcttcaaactagcagcaatcctcttgcctcagcctctggaatactaggattacagatataagctaaacacccagctaaaaatgattttaaaagaaataaaattggggctaggaaaatggctcacttagtaaattgcctgccactgccagcatgagggcccaagttcaaatccccagcatccactaaaaagccagatgcagcagcacacatctataatcacagcctggaactcagtgtctccagcctagctgaagagacgagcaccagtgagtgagagcctctgtcggaaggaagaaaaaaaaaaaaaaaaaaaaaaaaggggagaggagtgactaaacaggcaatcaggcaaacctgagatcaactttggtctccacaggggaacacatctacaaacatacataaaacacacacacacacacacacacccgcacatactacagaagatagtacactaagagaggtgtcagtgctgtctcataaatgttcaatcaatccacagaagcagaaagctcaggaaggtaaagataacaaatgtaactcagctgcacatgtggcagaatctaccctcctatgccagtctctgctcactgcacaagtctatgcatggccagacacaccgatgactgctacacactaggtttagaaactaactagagacagtatcaaaagcctatgaataatatatatatatatatatatatatatatatatatgccagtggtataaaaagaaacaaaagagcaaactatatgttgtctatgagaaacccactttagtgactatagagagatggctcaggattgagtgcctgtgccactcttacagaggatccaagttcaatcaacatgaggcagttcacaaccaccaatagctggagtctgagggacccaatggctcttgcctcctcaggtacctgctttatatgcacatacccaaacacagacttatacacatgctcataattagctaaaaatatattttttttaaaaagctcataatcacagtaataaaaatttatctttttttaaaaaaatgctttaaacatggtgttatgtctcagttaaaagtatagagactatgtggtggcagacatttataaacccactatttgggaggtggaggcacaaaggtcaggagaagttcaagaccagccttagttatctagtgagtatgcaccactccagagcaatacagagaagcccggtctcaaaaaacaaaaacaaaaacaaaaaaacaggagtgcaccaaataatatcagatcaaaatataggaagcaaaacctcaaagaactaccaagagaaactgatgagtgtttgaacttcacgaatcctcaatcaggcaggaaaatcagtaaggatggggctgacatgagtgccatcacgatcaactagacccgacatctgcagagtatttcatccaacaacagtagaacacacattattctcaaagtcacatggaacagtcaccagacagaccacatccttggccacaaagcactccttggtgagtttcaaaaggtagcaaccatacaaagagtgttctcaaaccaccatgtaatgtgtctagaactaaagagcagactggttggaaagtttaaggtatctggagatgaagcaatctattttaaataacttaagtcaaataagcttcaagagaaaacaaatatattttgaactaaatgaaaagataatttatcaaaatttgtaggaaatggcaaaatcaggatttaagaaagaatttagcacactaaaagcatgtgttagcaaaaaaaaagagaaatggctctagtctatagcataagcttctactttaacaagctcgggagcgcatgaccaaaataatttaattcaagctgtcttagggtttgttttggtttttttttttttttttttttggcttttagacagggttttctgtgtagctttggagcctatcctggcactcgctctggagaccaggccggcctcgaactcacagagatccgcctgcctctgcctcccgagtgctgggattaaaggcatgtgccaccaacactctactctgtcttagggttttatggctgcaacaaaacaccatgaccaaaaagcaagttatgaaggaaagggtttaataggcttacacttcaacattgctgttcatcactgaaggaagtcaggacaggaactcaaatagggcaggaaccttcaggcaggaactgatgcaaaaagctatggagggagctgcttacaggcttgttccccatggcttgttcaacccaccttcttagagaacccaggaccagtagcccagggaaggcaccacccaccatgcactgggccctcccccactgatcacccaatgagaaaatgccttacagctggatctcatggaggcatttcctcaactgaggctcctttctctcatgactctagcttgtgtcaagttgacacacaaaaccagccagcacactgactgtagttgctcagacatgtaacactcatgaggctgaggtaaaggataaacatgaattcaacactagcctgaaggactgactgaataaaacctggtctcaaaaggacctccccctccaccccccccaaaaaaaggaaagattaaataaaaaaattagatctataaagaaaactagaatcaataaactttaaccaggctaattaatgaagaaaaaggatagtgccagaaaaacaagtagggtcattattgatgatcctatggacagtaacaataaaggaatgtgtgagcaactctatggtcacaattttattagattaaatggaccattctctgaatggaactaccaagatatacataaaaagaaaaggatatgctgacaaacccatctactatacaacatttttacaagtaaaagtgggcaaagcctctaaacagacatttttccaaaggtgacagacggccagtaaatgcatgaaaaatgatctgtatcagtagtcatcatcgaaagcaattgaatcacatgagctaatgtcacaccaaccaggaccatatgatcacaaagtccaaaaataagaagtgtttgaggtctggagaaatggagctctcactccaggcagaaatggaaaatggcacagaaaaattcaacacagccaggaagaatggagtgtgactctaattccagtacttggaaagtagagacaggagggtcacaaagatttaaagcctagaggagttacttagcaaggccttgggatggattcccagcaccacaacacacacacacacacacacacacacacacacacacatacacacacacacacacacacactccctcccttccttccaaaattatatgactcagcaattctcttcctaggcaatgtccacaaaagccttgtacaccaagactcacaacaacagtaattttagtaagcaaaagtagaacctcaagtgtccatccactggtgaacagacaaaatatagaacattagtatgatggaaatcttttttggccagaaatcatacacataacacagataaatcttgaggtatactatcctaaatgaaagaaatcagaataaaagaccatatattatttgatcctatttcatataaaaaatattcagaggggctggagagatagctcagaggttaagagcactagctgctcttccagaggtcctgagttcaattcccagcaaccacatggtggctcacaaccatctgtaatgagatctggtgccctcttttggtgtgcagatatacatggaagcagaatgttgtatacataataaataaattcttaaaaaaaatattcagaacaagccaatacatagagacagaaaacaagattagctgctgccacaggccagagagaacaattgtgaagtaactgctataggtacaaggttgatcagggttttggtttgagactgaatctcaactaaccatccttatcatagactcactatgtagctgaggctggccttgaactttgatcttcctgcttttaccttccaagtactgggattaaaggaatgctattgagtttacttgtttgtttatttatttatttatttagtctgtttgtttgttttcctttctgaggaaatgttctaaaattggttatggtaactgtagcttagtacaaacagctactggcttgaatacgtaaatgggtgtgtgtgaaataagtctatcaacacttcaacaaagctgttacgaaaaactaaataaataatggacataagtgaacttttaaagtgacaggaatgccctaaaactattttggtcacagttgcatgattttataaatgcatttttctagatttatttgttatttttatgtgtgtggctgttttcctgcatgtatgtgcaccacacatgtgcctgcagaggtctgcagagcacttcagatccctggaactgagtttaggtagagatggctggaaactgccatgtgggtactgggaactgaacccctgaaccagcctataattcattaaaaaaaaaaaaaattccctcaaatggaacttaaaactagtaaaaaaaattttttgagacagtatataatggagcccagaccagcctcaaattcctgacttcccctactctccacctcccaagtactgggcttacaagcatgggtaaatttggttatttgctttacgtcttgataaaattgtattttaaaagacacattgaggactggggagatggctcagcccgtaaagtttgcctctcaagtgtgaagatctgagtttagaacccagaactcacataaaaagccaggcatggtgaagtacacagtaaccccagcaatggcagaggtaagctcaccagccactaacttggctatgtggtgaaggtcaagccaatgagagtccatgcctcaaacaaaaaagggagacagcatctgaagacagacacgcaaggctgtcctctgacttacacatataccctcctctgcatgtatgtaactgcactgacccccaaaaacacaggcatgtgcatgtatacacagacatacacacaataaatattaaagagtccaaaagggaacacagaactgatatgacatttgtagagcaagtattggattaaataaatacatttaaatctccaaagatcagttatcatagtaaagatactaaatattccatttaaaacaaagtttattatgctgcctcccagagaaacatttaagaaaagcttgacataaaagacttggaaataagccgggcagtggtggcacacacctttaatcccagcacttgggaggcggaggcagaggcagaggcagacggatctctgtttgagccagcctggtctacagagctacacagagaaaccctgtctcaaaaaaaaaaaaaaaaaaaaaaaaaaaaaaaccaacaacaacaaaaacctgggaaataatacatgatgtaaaggcatacaccacaagaaacatggtgcaatttatcggcaagaaactcaaagcaaagagcacttccagacagccaggctgatgacaagtgctgctaatcccagcacttgaaaggctgaagcaagaggactgccatgaattcaaggctagcataggctacatggcaacacttgcctcacaagtaaatgaagaacatgtccagagataagtggtttatgaacacaaatgtgccagtctcagtgggatgcatagctaaatccaaagtaaatccttaccacttcagagacactcagagtcttcaagcctttgagaacaggcagattcttaaacaggaaaaaccacataagtaacagaaagaactatattaaaaccaagcatttatgttcaccaggaaatgtgtctgctgtttttatgatagggtctcattatgtagcactggctggcctggaactatatagaccaggctggccttgaactcaaaggtcttgttgcctctgtctcctccatgcctggctcatcaaaaaatctttacagattaaaaaggagtcacagaacgggagaaaatatctataaaacattgctataaaaggtacatatatccagtggatgtagtggtacatgcctttaatcccagcactcgggaggcagaggcaaactctgagtttaagggtaacctggtttacagatggaattccaggctagccagtgagacactatttaaaaaaaaaggggggggtgtatgtcaaagacttctggttaagttaaaaagatgaaaacagggcctagagagatggctctgtgattaagagcactggtgaccttccagaggacccaggttcaattgtcaccatccacttggtgagtcacaaccatctgtaatgtcagttccaagggatctgaggccctgttctggtgtcctcaggcaccaggcatacacatgacacataaagatatacgtacaagcaaaacacccttacacataaaaaattttctaaaagaaaataacaaaaatttacaaactatttaacaggcaattcacaaaaggggatttctgaaaagtgagttaatgaaaataaacccatcataaactaaacacatagtgattataccattaaacatggtggggggacctaaagttaagaagattgacacaaccctatagggtagcaagaacatgaaactgacagacactgctgagaatggaaactggtatacacacctgagaacctctggtgatggattatcttccaccctagcaattctcagcatatagcctccaggctatacaaatgcaaaccaaagacatgaacatatcagcactattccagcgcccaaactggaaggatctcaaacatttctcaaaattaaaataaccgaattgtgattcactgatacaataacaagccaaaacaaagatggaccgaccatgacttcatcatcttcaaggacgagcctaaaaacaaaatgtggcttaaaagaatgaacttgatcaaagacaatggaacattattacttaaaacttaggagaaaataatgtgcaactcagaattaaacctgatacgtgagtgccagagtaaaagacattttcaaatatgtaaacatgaaaaaaaaatacctcttacatactttcctgggagtctaatatcaaatgtgttccaggaaagacagatacagattaagaatacaaggtctaaaacacaggaaagtcagcaaaaaacaagagttaaatgctctgaatttgatgaagggtgttctaagaatccagctgcaaagacaccaatccaaactccagtgaggaagaggaggatggaaaacttaaaaagccaaagttttagagtttggggtcaagttatgcatataaagagagtaaatgtaaaaaggatgcagttttatggtaggaaaagactcagaaggtttcatgtagtatatgacatgtctttatgagatgtatcatttaaatataatatgtacccccacaggctcatttttgagcatttggtccctggctagttgtactcttggaagattgtagcgcctttgggactgtaacctaggtagcacaagtggatactggggacagctcttaaaggtaacgcccaggttgttctagccagagcacactgcagcctgtctgcaccatggactcctactcggatgccatcccctccatggtggactacacttctgaagcctgagccaaaataaaactatcctctcttcagctgcttccatcaggtgtcagtcacagtgatgagagatgggaccagcatatgcagtgtgactccaaaaggaaaaatctaggaagggagatgaaggatcatggaaaagtctctctctacaaggagacttcctagattcaaactgcagtggtcctcacatgactacacacgcccatcaaaccccctagaaccacacactgaaaatgtctcaaaggtatagcacacgctcagcacatgtgaggcctgggctctagcacaaaaaaagagagagcgaattttactatgtatgcatttatatagcaataaaacaacatgaaaaggactattttgaatgccaaggaaaaatacattaagccagtaactttatgtatacatggctctgctataaacagtaattacatcagcagcagaatgtaatttataccaacaaccaaaactgtgatactgagagaatggtatagacacatgacatacagagtctaatcgtttacatgaggaagaaaatagatattatcaaattgaaaagtcaagaaacagctttataaacaagttagaaatactggctctctagcttcttggggccttctctagtgaaagcaatagctacactacggacaatggttgccttgggagaatggaagtcagagggaagagtggggcagggcattgctgttgtctgtaataagcctcatgacacccagagatccagtcacagtccaaacacttcagaaggaattttactacttatacattggcttacaaaacacttatttagaataacatgtaaagccaggcatggtagtttgtacctataattaatcttagcactttggacagagacaggaggcatgccatgaattaagagaccatctgggacaatatagtaagatccaggccagcctgggctacagagagagatcctgtctcaaaatataataaataaaaataatcgtttccactttgttttccttgcaagtagctgagccctgtgaaaaagccaccatccagtcatctttacagctgagttactggcaggtgtcatacagggttttcttttcaagcacttgtggtttgacagtttgcaggcatgataatcttttacatcatgttccctaagttgtcagcctgtttagtcaatgtgacatttccaggcattcacaattttcattcattgtctttactgccttccttttaaaataattaaaagctaatttctatgaaaacaaatgtatatcttctttgtttaatcctaagcataacatagctaacatctcaaaatacctaagtacaggcaaacagacattacaaaggataattaaatatcttgctagggtagtctgataacaagcattaaccactgaatacttgtatcctttgcaatggtgtttgtgtggtttcaacacaattaggagtgcatctgagggtttgtgggtacaaatgctactgaaattaatagtatttatacatttctgagacttacttatccaagaggttctttctccctctctcaccctcccctccctctctctcccctaaccagtgaggaaggggtctagcttttgagtcaggatctctctatgtaactctggatggcctagaactggcctggccttttagtgtgtaacagccctgcctgtttcccaagtgctggagttaccagcttgcaacaccaccacacctggtttcccaggctttctcagtatcacattgcccttaccagaaaagagaagtttttcttaaattcctaagtttcaaccctaattagtttcaaccctaaagcaaacagtacatgggggttgggggtgggcatgaaaaggggagggaggtgtgggagggtgtttgctagcttgtaccaggccccaagtctgattcctagtaactcacagaaatgaaagtagggagcatcttaaaaaacaaaaaaaaaaaaaagtgaaagtaagaacaggtgaaatctagagtgatcacaaagacaaaagaacagcatttgggaaacagaagggatcccataacccggactaccaaacttccaggctacagaatacttgaggatggtgggtgaccatctgcacaggtacactgttctagtgcccagtttatccagtctatctttcccctcaactctattggccctgaagacctgcgccctcattatacaggaaacagatttatttctactgcaatgggaagcagctggggagcttcaagcagaggattttaagacccatttttttttttttttgaggatcaaatgtgcagatgaatatgaaggcatcaataaactgcaaagtatcttggcatatttattaccttgacagaggacagacaaaaggttgggaagaaaataaggcaaatgaaaactcaaatagaatcagcccattctaactcttgtgacctacagtcctctcccaggctgctcctgtgtcccacttagcgagggggagactgagggaggaaaaggtttgatggaagaggaaccaagattctgatcttctacatgttaaatttttatctacatggacattcagagcaggtggctggaaatacctacccatgtggagctaaagaaaaaaaaaagtcagaggtagaaatatagacttaagagccatcagaatatagagtatttgttaaaaataataaaaactaacctatctgcacactcatacttcagttactatttttaatgcaaaaacttattttcctcaccataattttaagaggttagttaggtcctgggatgatttctattttacatataaagaaacatacattgtcaggcagtggtggcacatgcctttaatgtcagcactcaggaggcagaggcagaggcagatggatctctatgagttcgagtccagcctggtctacagagttccaggacagtcaaggctacttagtgagagcctgtctcgaaaaataaaaacaaaaagaaacagatattaagtatctttctcaaagacataaagcaaatatgtaccctatccaggtttcaaatcacaggtgtcctgactctgtaattctttaaagccatggggtcactggagagtgactataggcaaatacagactagggatacaatatttcagtttaaatagtttcctaagtccttcctttcaagtgcttggcatggtttcaggcactgcagatacaaagcaaaataagacactctctcaaaaaagtccagtctcattactgctagctgagagcaactattatcaaataaccagtatctggcacactggctaaactttctggacctatttcacctgattctcctaacaaccttataggatagatgtcctcactatcacttcagaaatactgaaactgagatttgaggagattatcttagcctagggacacaggctaaaaaaggtcggaactaggatttgattcagatccatcttacctcaaatccagacttttccagagaaattctaccatatggtattactcagataaaccttcagcaagagaaagtagaaagtggttacagaagctgaggaggggcatgaggagttgcttagtggatgcagtttcaggttcgcaagctggaaagttctagagattaggtgtgcataggtgtgaaaatagtaaaaagtactgaactgtatagcttcaaacagttgtaatgatcagatgctgtattgtatttttttttttatttaaaaggtattttttggcaggtggtgctattgttactgcccaacctgctgccccttgtagtctacttaatgaaatctgttttctttcccattccaccaccccctcaaaacgttttttaaaaacctggcacttttttactgtgccatatgcggtaaccaatatgtgtactgcactaaggaaatatggttgagcaaatgatttattctgcatagcaggagagaagatagggagagcatagcaaggaggaaaactaaaaactctactaagagaggaaactatgaactgtaaaggtttccattatcactactatttggaggacaggaattcctaattcaacctctgaaacaactccctcacctgtataaaactatcaaagaaatatgcaattacaggctaagaaagcaatgtaaccaaacaaactttggggattaacagagtaatcgtgaggaccacaatgcccagtcaaaacaggctttaagaataatccaacagtcttccaacatagtttcctagttcatagtttcaacactggaaacaaattatttccctaagttgcctcatccagcatgttaaagatttctatggctcactgtttttaggacacagattatctgaaggggtatttagaatctcattgcctaacctttttgaacttcaatttcctcatctgtattaagagatgaattcagcacatggctcaaaatactgaaaactgctggatgtggtggaacatacctgtattcccagcactacctcaagttcagggttagtctaatctatataataaactcgaagccagccagatctatgtaggaagagcctgtctcaaaagtaaacttacttaaaaaaaaacaaaacaaaacatgaacaccttgcacactgattgatccaaagtatgtgattattaaaggtcagtcccctctttgcttgtctctacatagtgagctcagtgacatatcctgacttcaaggacagaacaagtattcctcagatcttcttagggcagatgcagaaaaatgcaataaaggaaagatgctcatccacagtttctgtaagaaaatatggctacccaaaagtgctccttcatctgcaaccctttacaaatacagactatctcaccctcacccttttagtcctttgagtaatattcaaatggctcaaaattaattttaaatatgtaatggtactttgaaaaaaatctcacacctattccattccctcatccacacacctaattcccactcctctccaattcaacactcaactggtttcttgtgtgttcctgaaaatcatatgcaaaactatcttttacttaagctaatgttctatctccctcccaccccctcctcggtttgtttttcaaaacagggtttccctgtgtaacagccttggctgtcctagaactcaatttgtagcccaggcttccctggaactcacagacagagacccgcctgcctcctctgcttcccaactgctggggattaaaggcaggcacccagctaaacttccgtttcaaagcaaatttctgggaccacctgagaggatgaggaaaatgtgagaggagtcatccatcctgcattattcaaagtagtgtcctgtgcgcgcacctacgcgcgcgcacgcacgcatgcacgcacgcgcacacagacacacacacacacacacacacacacacacacacacacaaacacacacacacacacacacgccacgcatgtactggacttgcgtatcaatcggtgtgatgataagctaggcattaaatataaccttaactgagcgctctccggcccttatctgcacctgaaatgcactaacactttacactactatctcctttgaatttagcaataacctgaaactaagtcactgaaagataacttgcacaagcaagacagaaagtagggctttgaactcgggcttgactaaagttcttcctccaaagcatgtcgccctacactggcaaaacagtctctgcacccgttggagctcagcctaatgtgggagacaggcgtgaaaagggcacacaacaaagaaatatgcaattacaggctaggaaaataatgcaaccgaaaacgaactggaggatttgacagaataacaataggggcctactttcgaagagggggagcaacgttaaggcctctttgagaagatgacatctacgataggcttgcgaaccgtttggggggctgcagggaggaggacccggtcctgctcacaaggggcaaacgccaggccagtagaagatgaagccaactcgccaagggcccccagacatgcagacgtggcgcagggaaatgaggatctagaaactcggcccagggctcatacgcgccatccgcaccccggcagcgcgaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccatgtctcctcgtccgacaaacaggaagcaagcggccccagagccgcgtagatttctacggggcggcggaggactctccacatcgcccccagtggacagacgcggagatgcaggccgcgtggcgggggggtggggggaaatgtgcgcgcccggaggtcttatgggaagtgtagtctttctcccgaggtcgggcagatgacagagatgctggcctcctggacccacctgtttccccacatcccacctccagcatttctgtgaggttgctccagatggaagactgatcgctgcgtgggcatgctctcgaatttcttgtctgtttagggatgatgcagccgagtggctagtgaaaggccctaggccagaattgtggcttgattctgagttctgtccccttctttttacgactgcctccagccaagtctacccttgctcctcagttagttcattcaatatgggctcagatgagtcaactaacatttgtattataattaacaaatatatcttatgtaaataatatataaaagattcgaagaaaatggtagaaaacatttcatgaattacaaaattgtgttgagattttacagatgtcaataaataatttctaagggagccagctgtactcctcacactgaacaatagaggacgtggagggtgcggtgatgagcagaacagtggagcaccctgtgaggggattgagactacagggaccacagcaagtccacacacaaagaaatgtaactggcgaggttgtggtcaagttcagtgaaataatgcaaggagtggggttggtaagtcgtagcctctgccaaacagaacactgcgctgatttccctgcgctagtgtgctctctctctcttctgaaccgctgtagcgcggcggcagcggtaaccactctttccctgttttctctccagggagagctgaatgtgctgaattgggatgtcatgaagtttgctgcttgtaacaaaggaggctttaatttgttacacaaaccaaaatcccgtaaagtgtgaaatgatgtaataaataattagactaaaacaacagacatttatgggcactgccaggacaaactagactgtggttactatctttttgtttaaattttttgttcttttcgagacagggtttctctgtgtagctttggagcctaacctggcactcactctggggaccaggctggcctcaaactcacagacatccgcctgcctctgcctcccgagtgctgggattaaaggtgtgcgccaccagcgacctgcgtggttaccatcttaaaatgcccactttagaaagtatgatttctgctcacctccagcagatcactactagattgtctggtttaaaacaaataaaatagggctcgagggatgaatcagcaggtagaggcagtgggctgtcaagactgaggacctaagttgggttccctggaccaatattggtggaaggaaagaaatgactcctccaaattgtcctctaatctctctctctctctctctctctctctctctctctctctctctgtctgtctctgtctctctcatacacacacacaaattaaatgtaatttttaaatttaaaatatatatatattgaggggctggagagatgctcagaggttaagagcaccgactgctcttccagaggtcctgagttcaattcccagcaaccacatggtggctcacaaccatctgtaatgagatctggtgccctcttctggggtgcagatatacatggaagcagaatgttgtatacataataaataaatttatatatatatatatatatatatatatatacacatatatatatattgaaagagatcaaggaggttgcatatggaagggtttggagggaggaatgggaagaaaagtgatgtaattacataataattgtgattgctggagaaaaaacagaaacaggaagtttatcctgtagtgaaggagattttcttcaaaccaatggaaaaaaaaaaaaaaacaggccttcaactttacactaaaatctaaaattcatcttaggaaaatcaaatctaaacataacaaaatcagagtgtatttctaaaactgggttgcggtgacagtagtgcagctacatacatttatatacatacaaatcactggactgtattcaaaacgggtaggttttgaaatataaattatacttccacaaagctgttaaaagcatatcatggtatatatacatattcatacacatacacaagctaattaaataaatacatgtaattttaaaataaaatggacaaaaagttttggatgactaataacagataatgcaacatcttacttctctggcagttttacctgtctggaagaaagtataaggtcacctttgagtaccccgagatatcactcagttgttgccttaaaacttacctatctcagcctggtggtggtggtgtcacacgacttaaacagcagcactcaggagtcaaaggcactggttttctgtgaattgaggtcagcctggtctgcagagcaagtttccggacagccagagctacacagaggtaaaccctgtcttaaaaaagccaaacacccaaacaaaaaaagttaaaagcataaaatgtcagcaatgaatggaagataatcctcttatgatttgggggaagaaaagtcttctcaagtataaaatccggaagcatgactagaagacctcaacatcaggataacctcttgtacaagacagcatgaacacccatagaaggcacgtggcattctgggaaagagttaacttagtattatgaagaacttctgtcgtgcttgccttgacctccgctccaggtagctgtctgagctgctggctttctcatccccttccttctgatcaaagactgctttgctgaacacagatccaaagcgccgtctcttctgctctcacgcctgctttctccacttgacataaaattcatcattctgtccacctctccagttagagctattcgtgatgcttagtactttgccatgctcaactccagtacccagaacagtgcctggaacagtcagtgatcatttttttttttatataatcaatagctcactgaacagataaagctactcctacaaaattgcaacaagccaaatagcacagtagaaagagagggtatcgggaagctggtgagatgacctgtggtaaaggcatttgctgccagctcagaagacccgaactcaaaagttgagagcagagaacccattcctgaaagttaacctctgacctccacacaagtgccagaacatccttgttatgcatgtgcacatgtgcgcgcgcacacacacacacacacacacacacacacacacacggtgtgtgtaaataaataaataaatgtttttaaaaaggaaatagatgagctgggtggtggtggcacatgccttcaatcccagcactcgggaggcagagacaggctgatctctggtctatagagtgagttccaggaccgccaaggctacacaaagaaaccctgtctccaaaaaataaaaaagaaagaaagaattagatgggcaggaataggcaagtcttagaacaacgatggcaaatacatgtagagaaaacaaacaaacaaacaaaaatgtaagtctcctagtttccccaagtggaatgctgatggtgagaaggtctgttgtgctttttcaggaagcaattttttatcagtatcaagtgagttagaagcatacttcttttgactcaataactctccttcagcattacactaaatagcattctagctagtataattctagaaaacatagccaaaacaattagtcaagaaaaaaaaaaaaaaagaagtggccaagttggaaaggaagaagcaaaatcatctctatttcctaccatccatctgtaggaaactaaagatttccacacacaaacagaaccaaagaacaacctcagtgaagtttgcacaatacaaaaaccacaaataaaactgagcaaatggggttggagaatgacagcttggctattaaaatttcctactgttctctaagaggatctgagttcccttcccagcacctacactgggagctcacaccagctctagggggacttgatgccctcggctagactacacaggtatctacactcacatgaacataccccaagaacacacaaatacgtttaaaataataaagataagtcttttttaaaaccttcacctcaaatttggttcttaaggactccatatgactaggaattaaggagaaaggttcccaggtatctgtgtgatgctaagtgcacttcatctctttcctgccactttctcccatggagacaagctgctcctcaccaccagcatccttctaccaaggggacctggatttgggtcaacatggaaaagaaaattaaacaaaatggaaactcttagcttgactaattttttttgcagtaatcccatgaagtataactacatatgacgctgtaaattcccagaattaactaccaagatcatctcaattaggcatacagatttttctagagcaatttttttttaatcatggggaagtcataatcaaagagaatcacattattatactcaggccatagtaagaaatgtccatgtaatcacgcagcatcttgaggtgtaatttttaacactattttcatattttgtttctaatgtacttaatgtttgagggtttttaaattattttttacagtgtgtgtgtgtgtgtgtgtgtgtgtgtgtgtgtgtgtgtgtgtgtgtgtgtatttatacatttatttgatgagggagaaggtgcatgtgctacggcacacataatgtccttttctttccttttacctgtgggttctgggttcatgtccatgtttggtgacaagagcctttacccacagatccatccactggcccaatggtttgttgttttaaatagttactttatgggccgggcacctgattggtctaataaagaactgaatggccaatagcaaagcaggagaaaggataaatggggctgacaggcagagagaataaacagaaggagaaaaagagagaagaaagagcaaggagccagaaaagaaggagtcagccacccagctacacagccagacatggaataaaaaggaaagaaaagatatacagaaatagagaaaggtaaaaacctagaggcaaaaggaagacaggataatttaagaaaagctggcaagaaacaagccaagctaaggctgggcatttataagtaataataataagactctgtgtgatttatttgagagctggatggtgggcccccaaaagagcaaaggagtataaaacaaccaactacactccatgtcattatttgggaggtggcagtatgaagaaagacccattacaaatggtgtccagcgtaagtgcacatatttccacatagggcatgagaaagagacctcttgagtagcctcagtgtacagagtctttttaaagaggccctgctacaaagtacttaaatggggtttatgagcatcaggcatcactctactcggtggcaggggactaggggactaggactggggcagatagactggctccaggccagacctctaggcatgaggctccactctcaccaacatgaagagggcagagccagatgccaagccatgtgcttacagaggagggcctagttgctgcttagcaatttaatgtttggctcacagcaaagaatgctgtacatgtgaggctgaagacacctagtaaaatctagaccaagaaaacctctaaatagagtaagttttaaaatgtgctaagctgctaaagaaaagaaaatagggatagatagtcatatggttttttaaaaagattatttatttactaagtatagtgttctgcctgcatgtatgcctgcaggccagaagagggcaccagatctccttacaaatagttgtgagctaccatgtggttgctgggaattgaactcacaacctctggaaaagcagccagtgttcttaacctctgaggcatctttcctgccccagaaaaaaaaatagtttataaataataaatcaagtctttaaagaaagagaaaaataagctgggcggtggtggcacacacctttaatcccagtactcaggaggcagaggcaggcaggtaaatctctctgagttggaggccagcctggtctacaaagttacacagagaaaccctgtcttgaaaaacaaaagaaaggaagaaaggaagaaaggaagaaagaaagaaagaaagaaagaaagaaagaaagaaagaaagaaagaaaggagaaatgaaaaagaaagagaaaaataatattttttaaaaacatgtaaagatgggaaatacacagggcatctgtatcctgtatggtgctttgttgactttgaattttttgaatgctaatgtacagagaattacagctgctgagaaacagtggattatgggagagactgctgaattaaactaccctatatactttagggatatcttggcttcagaatggaagttggacaatgtgttgtgttgattcctttatagttcaagatcagatttgaccagaggagaccccatgaaaatcctggctacagacataaagaaataaacctagaaaaactacaagacagagcaagaggaccagtcaccaatgaaaatgggtggcccaggtgatccagcctcccagagtgcctctgttgcaatttcctcagagttctgtatccagagaagcttcaagtctgttggccgagatggtgcagcctcacagaccattctagttaggactacacataagccttgcactttcccattgcaccaagaatggacaacaaatgttatggctagtttccccagaactgggccattatctcaattttctcagggtcccctaaagatgccatcatccccagacaacaggaagcagtctagagaacatgacacccacattctcaagaggtgggtagcttttggttgtttggtggatatggatgttgtcatcatttaggggggttggttacaaattgctggtcatagtcagggagaaagctaaacaaaggaaattagattcaagaatctctttcaaaaaggaagaagggggaatatagtatagaaatgatggaataagagggtggattgttgagtctccttttgaataaccactattttacattggtatggaattttgtatattgatacaaatatatttgtatattgtatatacaaatttgagattatttttatactatatatatgtttctattcttgtttaaggcattgtacctatgcaactcatttaaaaatgtaaagttttagtccttaaaagctatttaagaaaataaagaaatgcaggttagtagtcatccataacaatcaatcttatagtcatgttaggtgtgttttcaaggtcatacaaagatatattttagataggtgatcttcaaacacttcaaagacttacagaatatggcatttaaaatgttttaataacataaggcttttcataacagtgagacacagctgctcctggcagcaccaatttgcttcataaaaggatgatgggccttgaagaacttccatatggagtttgctttctttgtgtcaaaagctagccatttgagcaagaaattgctgacagtatgctttccaaattggacaagcaggacacaaaaaagacaactgccaaactttgccaaggcaaggtaggacagttcttcaaaattcctgcttcatagaaaagtctgtcagatatcttaggcctgtaggctgaagatggatgccccaatattacaaaggaatcttgggatgactgtccaggtagtcagatgcctctgttgtttcttagttttgaaagttgtttgctctgcatttcaagtaatattctatccttcttggctctctgatggagttgaagatgagatagttacagttttctttgttacaaaattgagaaaaaaatttacaaaagagatgtaaaatgtataaggttaagtgatataaaagcttaagttgttgatctaagaaaatgttttaaggtctaaaaagatagttttaagatggtaatataagttatgatagaaaatggtttaggtataaaccattcatcaagataaggtagataataaagtattttctctgaatatgccaaatacaaatggactgaacattatgaatgcaattcgttacccaataattgttctcattgtttatagttttattatgtaagaattaaaacctttcctttttatttagataaaaggggggaaatgttgcagaatagtcctttacactgtgtgaagatgtgtcactgtgattggtttaataaagagctgaatgatcaatagctaggcaggaagaggttaggtgggacttctggaaacagaaaggtctgggggaagaagaaaggaggagtcactagtaggatgcaggggaagcaagatattcaggagacataaaagccaagagctggggctggagagatggctcagaggttaagagcaccggctgctcttccagaggtcctgagttcaattcccagcaaccacatggtggctcacaaccatccgttatgagatctggtgccctcttctgatggaagcagaatgttgtatacataataaataaataaataaataaataaataaataaataaataaataaaatcttaaaaaaaaaaaagccaagagccatgtaacagcacatagattattagaaatgggctaatttaagttataagagctagttagaggggcctggagagatggctcagaggttaagagcacaaactgttcttccagaggtcctgagttcaattcccagcaaccacatggtggctcccaaccaccttgaatgagatctggtgcataatgagatactaaatgcataaaaccatttaaaaaaaaaaagagtataaaaaaaaaagagctagttagaaacaaacctaagctaaggccaaactttcataattaaaaagaggtctccatgttattgtttgggagctggtggtacagagaaagacttgttacatcatccccctactctctagagaaaactcttcttcccaggaagtccctctctttgtgagtgacctggtgaatttaattagagtcgcttacaagaatgtgcctgggaggttatttgccagcacttgggcaataaaacataaaaggccctttgtgtctggcttctagctagcatgaattttcgagattcatctatattgtagcatttggcagaactccatttcattttggggttgaattggcaattcccatcacattgttctgaggcctctgccatctctgccacaacctgctgtcttcattacttatttcttcacatttctagttcagcccaaagcagacaagaaaatctataatatgggaaagctacaagacaactccatcttttcaacaaattgtaatcatgtaattttttttctatcaaaggtagttatcccaataagggtatgttgtagaatattaaagatgtgttacatttgtttatggggtggaacatttgtttaatggtgcaaatatgtgttgcatttgtttaactctgtgaagctgtgttactttgcctgtctaaaacacctgattggtctaataaagaactgaatggccaataacaagacaagagaaaggataggtgtgggctggcaggcagagagaataaatagggggagaaatctggtaagagaagagatctaggagcaagaggaggaggaggactccagggccagccacccaactacacagcaagctacagagtaagaagtaaagaaaggtatataggataaagataaaagcccagaggcaaaaggtagacgggacaatttgagaaaatctgggtagaaataagccacgctaaggacggacatttatataagtaagaataagtctccgtgtgtatatttattcgggagctggatggcagacccccaaaagggaaaaaaaaaaaacaaaacaaaaaacaaccaacaacaaggataccaaatgcctggacctctcctttcccctttgctctgattagcctactatgtcagattgtgaagttgagttctcaccaatgggatgagacacagtcactacctatgttagagataaaagacagagaccatctggccagcatgttccctgccccagttttggttcaggtgtaccctttttgcaaaaagaaattggcaagttacttttgttttgtttatgtagtcctttgtgggacactgagattattcttttcttacacaacaaaaataaaaagtaagaggatgaggttaaagagatggctcaggggttgagaacactgactgttgttgcaggggacctaggttcgattcccagagctcacatggtggctcacaacctctgtaactgattctaggggatctgatgctcttttcggacatctgtaagtaccaggcacatatatggtgcacacacatatatgcatgcaaaacatccatacacataaaataaagatgagtggaaagagggaaaggagaagggagtgtaacaaaggcagagaaggaaagaggattatatatcagatgacattgcagaagcatgttgtctaattaccaaatacaggaattctgcttagatcctgactcattaaaataaaaatttacaccacagtaagaattttgaacatgaattagaaatttaaaggtcttaaggaatagttgctcattttggtaatgagctctgtattattttattagacagagctcactatgtaggtccggctagcctcaaactcatgatatccctgccacagcctcctgaatactggaactatatgcctgtctgccatgctcaccttccaagatactttcactttgggttctacataatatttcatggaaataagtaaggttgcttgtaagcctaccatctttttaactcttatttatccatccattcattccttcatttgtgtggtgtctgtagaagccgaggaggtttctcaccaaatctggaacaagaaggcagtcagcaagcccagggaacctctggtctccactctctgttgctggtgtgtgtgtgtgtgtgtgtgtgtgtgtgtgtgtgtggccacaaccaggttttatgagtgctgggatcagaacccaggccctcacacttctgcagcaaagcattcctacccactgagccatctctccagccccaagtctactatctttgaaggtaaatttgttgaagttgaatgaaaagcacgagggaccgccattttgttctggtttttttttttttttttctgatataaaaattctcctctaccaagagaccctcccagaccaccctacccaaaggttgcttagttttctccccattactaatgtaacaaccacttctcttccatcctccccccccccttcctatttggcatgtgtttagatgtgtgtattagctccagaggttgacatcaagtgtcctccttaattgctctccactttttgagacagtatcttgcactgaacccaaatctcacaattcagcaagactgactactgagcttagggatccccctgcctcttccctcacacactccacctgctccccccaactccagcactgtgatgacagacactgctgggcctgtagtgtggtgctggggatctgaactcatacttgtgcaaatgaaccatctccagcactcactctgactctgttcttcactaaacttacgccactgtcacttcatacactcattagtgtatttctctctaccggaatccagttccaacaggaataaaatctgttttgtttgtttgctgttactctctgggactatggctggcacccaaaggtgtttaatagacctctactgcccggaagaacgcatgcataggggggacagctaaaaggtgaaggcacatgttagaaaatcaacaaagaaatactggcaacatcaccttcctcaaagatgccagaaaaggaagcgactttcaacttttagccctgggggctgtggagctactttggtgttttgccatatatccaattggctgcaaaaaataaactagattcatgattgttagcacaaaccctttttttgagtgaaatctcatcaagagtccatccagtatgtaaaacctgatagccaaaagcaaatttattattttatagcttactctcaaaaaaaagtaaaaattaaaaaaattatccagtggttatgaggaatctaggaaaacctggcccagcaatgccagtttggaagtgaagggctggctagggcagctgagaagtggggttctctgcttggcaggctgcttctcccttggctggtcctgttttccaggtgcggagggtgagcctggccctgctggcggctcccagggccctgagctcgtcgtctttctctgagctcttgacctgctctgcttgagcgagtggagctccctcatcaagtcctctacttcccactgctcctccttcagcctccggcaacagtgcaaggcagcagggtcaatgggatgagcctctgtgttgaagatgtagccgccagctcccaggatgcattccccatggggggtcatcacagagtcaaaggtggagccgttgttgtggatgaagttgtttgggtgaaacagaagatagaggtatttcacagtctcagccaggaagaatgactccatgcgattgtccagcttgtggtcccggaggtccttgatctgccacaggagaggaagaagagagtcagaacgcaccatggtttgggagtaagggtcaggcagcccagtttataaactgctctactaaatagctgagggcctttgggtgaatcacttctcagagcttcactctttccaagccaccatcacctctcacctgtgtaatgacaaaaactgggcttctgcgtctgcccttccctatagtacacttagattgcgggtcttacctgacccttctcataactctctgggacatctcatttcacacagactgaaaacctgagtctggcggttccttcaggacctagaccctgcttcctctctccctcatttcttcctacttggatccttttcttgcagctccatccacaaagcacactcatctgagtctttgtgagtatttttaaacacagatctaagaagtgagggagccagctatgaggctgatagggggaacaaaaaggaagtgactcttcctctgctcctctgcccctctgcttctaataaggtctttttgaactcttgaactctgctgtggtctctttagccctttgtagctattccatcacctattcacatttatacagacccacagatggtcgatatagatagatctaactcctgcatgatgtacagtgtgtaacccaagaattaatattattattaaagattggaataaaagaacatgtgtttgccaatggatagctatcaagggaaattgggactacttggaaagctgcaaccaacgacactgtgaaaagatatcaatgtgtccatctgtttccaacacagtgctcatgacaaacaatgacacatattcctgacctgacccttccttatgagcatcaggtttttaccattgtaaataactaactaggggttggctatagaaaatttcaaaagttcacaagcagagatgtgaaagacccccggaggctcaggcccccaggatctctgcccaggaccacggcaaccccaatcaccaggtggaggtgaaagcttgatgcaaacagcaagaggctttattgcagttgattaacgagctaaccccatgttagctcaggcctttcatccatccaccatggcggatggctaggaaagacactgcgaagccacggcatagagatattatagggcagcgtaaggggagtgtttaggggtactcacaggcccaggattggtgtgcctccaagcttggagggtttgccctgtgttgattggttaactggttgttatggcccataggccctcccagggtgattgctatgctctgtgcatcattgctgtgcacttgtccataaagcacacccagagccataaagcatagcaccaccagctaacttctgattggttccttgccacgaggcaggcatctgacctcttagtgaccaaggcaaggtcaggcaagcactgcaaggctgttatggctgccgaaatgggaagctggtcccttcagatgaataggataatttactacaaatgcttactttcagcttcttagattcaccagtgcatttaaacaaaattaattctcagtggacatttagcttatgcaatactgtgattcaagtatggactcagtcaaagaccaagttggattttcttcccagtttgacaaagattgaagggctgttcccatcatgcatcttgggagacctcctggaggcccccttttcatggaaatgcggttagctttcccagtggactcatcactgtgggttttcagagaactgagcacactgggagccaaaacaaaccactgcttcactactgcattcactacggtcttctctatcaaaaaatgagtctagcaggaagcagagctcagctgtagagctcgtgcccagaatacatccagccctaggttcaaatttaggaccatgaaaagaaaaatgacctatctatacttaaaaaaataccaacacattaaaaatttttgcaaaagttttgctgttttgttttgaattccacaccccaagacaaactctatagtctgtcaggaaacagccagcttatttacttagacatctgttttatgtgtatacaggggctgtctgtacctcccctgctgggtcctataagggtgtcaacctctctcaagggggagctagtgtgttatttctaaagtacaaatcaggtcatggcactgctctctgttatggatcctaccccaaattccactccctcctgtgcctacaaaggccctgcctgcgtcatctacctctgccctttctgggacctcctctccatccttcctcctgctcactctcctctgtctttctttctgtttcccagacacagttgcattatttttccaactaaaatgtaaactcatgagagcaagggtctgggtctgcctgtctctaacccatggcctagaacaatgcctggcacatgacagtcctacagtaaatacccgtgggaacagcagaactgtttattaaggagcccatgtttgaattattcgactttagattatttatttattattatttagaccaggttattcgactttagatttcgtctcttaaaaatcatttaaaaagccctgggacaaaactttctacaaacactactttgtaaatcacatattctgacagataaggactgctggtgcagaggtaagccaagagcttagggtctaatccaccacggtaactaggcctgtgccatttgtaaaactccactatggttaattatgacaattccagtaactacaataatttggtttctggaagtggattaacttgttgctttgtaagtttgaccgccctgccctgggggccccacgtagtagccaccaggaaagatgtttatcacctaacatttccaactgtctactcactgcttacccctagcaatgacaaaccacaaaccaaaatgaaccttttcaatcatcttccatgctctctcccttgtgtcctattaactacaccagcttgtgagaagacaatgggctctgattcttacagatccctctctggacatctttccccagaaaggcctgtgctgtctgactcactcttcccttacctgtcttcctgccttgctaacctttcacacttccactagacagtgaccttcagcaagcttctctgttcatggtttacaaccactcccttcaggagctaatgctccagcaccaccaaatcaccaccatggcttctgagcagcaagaagctcttaaacgcttaccgtggcaaatccacattccaccttgctgattttctcaatggactccacagcatctctcccgagttctaagagagtgggatcccctgtggcacggtagaggtacattgcgctctcgatgagctctgaaaagccaagcaaaccttctcagtggctgagcagttatggcatggcgcccacacagcgaaggcaacaaagcatgcctcgcctccatacctggtctattgtgccccactggagagaaacatggcatagcttttgggactacttggcaaactgcaaccaatgaaaccactgtagcttatgaatttattatcaaataagttctgatataattatggaaagactgaaggtgtccatggtgggttttcagagccaagatgcacacatcctgaagctccgttgagcccagcagactcccattccctggagagacagaggcggcctggctctgggacagagaaggtagaggaggttgtgacctgttccgcaatgtctgctccctgcctgccgtcagcagctcatgtggctggctgactagcaactactcccagctgagatgtgataagaacagaacatggtgccatgaagaagcacttgttcaacacatggaaagctctggctatgatatccagaaaaagaaaaaaaggttgactaagaaaagtcagcttggcatagtggcacacacttaaaatcccagtccttgagaaatgaaggcaagaacatcagaagttctaagtcaccctcaccagtacagtgagttcagggctagcctgggctacatgagactatggtaaggggctctagatatttttaagagtcctattctacaccacagctagattatgatgtttgaccaggggccttttcctaagctggatattggctaatgggaaggggcccaggtgagactatttaccattaaaaagaaaatacattttttcaaatacatgaagaatttttatgggaaaaaaaatgattttctgctgttgacagccttggtgggcagaagtgagaactcattgtgttttcttttttctttttgggggggcagggcgggtttcgagagctttggaacctgtcctagaactcgttctatagaccaggctgacctccaactcacagagatcccattgtctctgccttccgatgctgggattaaaggcgtgcgccaccacacctggcttcattatgttttctacttcggcactaactggttctcaaatcaatgaatttctctcttccttccccaacatctctccatcttctttcttctttcctggttcccttctgatggaagggatcccacttattcacccatctactcatttctgcagtgctgggagcagagacagggctgtgcacatgcgaggcacacccccaccactgagcagtgtccagcctcatctactctattttgaagaactagtctctgcctatctcctcagatctctctcccctccctcctctgcccccacaggcctctaaacaagtgctaatccaactgttcacatcctagggtgcattccagggcagacaccacacacagaaaagacagtgctctcgtgggaggccttcctctgctgccagcagctggctgggtcaaggccaactttctctctttctcacacatgagcctagtgtgtgagtcagtgcttgcctgtatgctgtgtggtcatgtccatgtgcccttccaccctcaactcaaggagctaaaggcccttacagtagaggacttcaggctaggttctgtaactgtcatcaaagtcttataccagggtaccaagcactagccagcatagctacagaagagcatcttctctccccctattgttgggggtgaggaagagtgactcaactatgaaactcctaggactcctggcagtgatgtgtatttccctctggaaccttcctgccagccagtcctgcaaatagagcaggtgcctccataagcagcgagatgtctctggtggtgactagggcaggacttgaaaactactgggtccaataactgtaggaggagttcagtatgaagggcctctctgaagccccagtgctgaaactgcatctaaatatttgacaatgtagtcacaaactctgagttttattttatctcctggtaacaaaaaacatcactgatacttcccaggagttttcttaaaataaataaaaaaaaaaaagccatgagaagctgggcattggtggtgcatgcctttaatcccagaactcggaaggcagagacaggtggatctctgtgagttccagactgacaagagctagttccaggactgcctccaaagccacagagaaaccctgcctcgaaaaacaaaaaaaaaaacaaaaaaaaaaaaacaaaacaaaacaaaaaaaaagccatgagaacaaatgtcagagaaatatcaagagcagccctagaagtccctgtatgtcattcctgatccctctactagtgtcattttactcttctctccctcccagggtgctacactcactggggttagaagcagcagggaatgggcagagaacacagaacagggaaaggcactaggaaggccagtcttgtggctcaaagggaattcaggtagcaaggtgggggtgggcagggtgaggggatgaaacttgattgcccaaggtcccaggttccaccactccatactgtggaagtgttctttacacaaagcactcacagaagtggcctacagtttatgacgtcctggtggcagaagcacccaagactcagcctcgctggcatctctcttttgctcatttctccaagtttcaaagagcataggatttagacaggaaacctgggttctggtccccgctcctgccttggctaagccacttcaaccagccagagctcagttcccatacctagcaggaaaaccaccgagagtggttagaggagagaaaagctgcctggggagcacctgtgaagggtgagggtgtgaagaagcagtgcctgcaggttggccacggaccaaacacactgcttacctggtcgaagtggatagccttctcgcttctccactgtgtatccctgagcaatgttgtagaactctggcagccccccaaactgcttccatacagtgtagtagttgagaaaggtcctcatggcattgtcaatatccccaataaggctctgtggaaaagcagtggtcaccaaggtcagcagactcaggcaccgagtccatgggtaaaacatcaccatcaacctcaagggaaagacaaagcaagccttggaagctaaaagtgctattgaccagtcctaaagttgatcactgactctatgcagccctgagccacaaagtgaatgtcttgtaagacataaaactcaacacctattcataccttgctgaggacccgagattaagtctctggaccttcttgaccagtgtctgctactttggtgagctgatccaaatttctaagcatagggtaaggctgactgtgctaagactcatgaggctcccacacctccaacagacagccttgtccactaatttcctttagaatgtttccaagtttctttatgcagacctaagaaaatgagtgtgttgttttcttacacagcccttcagtcatctctcctggtttcctcccacacacaccgagtacccaccttcctgttcatgcagctgcacaggggtcagtcacccaggccaaagtttaccctgttctataactagacatttggtttggttccagtcttttgctatttgctaaaacaattaatgctgcaatgaatactgcctatacatcacttcaagcacatgaaaatgtatctatctgtaagacaaatctccagaaacaggatttgtgggtcagaggatatctgttactagtaagtctatttaaagaatcctttactttctttcctcttctcttctcgtctccttttcttttcttttcaagacagggacttaccacatgactctgtctgtactggaacttgctatatagtgtaggttgatctcaaactcatagagatccatttacttctgcctctcaagtgttggaattaaaggtatgtgccaccatggccaggtcacttacctatattttaaaattctacttaagaacttaaaaaaattaattattactcctactggtttattatagtgcaacagcaatcttgatttctttgtgtttccttgactctttatatgtgcatgtgtgcatgtgtgtgtgttcctgtgcctgtgtgtgtatatgtatgtggaaaccaatagacagcctcaagtgttgatccttagaagatgtccccttgttttttgtggcaggtccctcactggcctggagctcttaccaagtaggttaagtttagtaagttccaggccagacaggactatatagtgaggctctctcaaataacaaaacaaaacaacaaccacaacagaaacacagtaccaaaactcaacttcctcaacagtgttgtgggatattttatcatactgtgtaaagatatgtcactgtgattggtttaataaaaagctgaatggccaatggctaagcaggagaggttaggcaggacttctgggcagagagaggaactcggggatgaatctaggcatgtaggagatgccagcaagacacggaggaagtcagacgtacattatggaggacagataactagctacatggcaggatgtagattaacaaaaatggattaatttaagttataagagttatccagacaagtctaagctaaggctaagcattcataattaataagaagtttccatgctattatttaggagctggcagaccaaaataaagtccaactatataacactgtttcctgaacacaggctttatgtttataacacaaaggtagactgtctgttctcatagcctcttaagtgtctttctctcaacacttgggaggcagaggcaggggaaatcagaagttcaaggtcatcccccattacatagtgaactcaaggccagcctggaagatatgaggtcctgttataaaacaaaggcaaactgaaggcatggcatcatttagattacaaactattttggtacatgaaatattgtggtacaggcagggaaggttagatgggctccaaggccccttttaattataactctatcagagtggatcagggaaaaaaatcaggacagtgggcagagcagtcactgtgtcaaggagggaacatgaaagaaatgcccagtggaaaaacagctcttgccagtggctgttcctacctggggcctggagcaacactgcacattgctacagatggcactacacccacagccactgggagctcagctccttaatgctcccttgggaaccatggtaaggtagattcatgcatctgtctaactcactttagttctttcttccacacactgccccagagcactcaaacaactaaagttccttatttgatacattagaataagcttgcttacatcaccataccacagaaaaatgatcacttgctttgacaagtcctacctgaagaccaggccagtaggcctccaaggactggaagactggcatggatacggtgcccttgtacatctgcacccagaggtaccagtcatcgaagtgggtgtaattccgaatggctctgttgtactctgcatcatgggagatcagaaaatggacacaggtgattgaagagacagacaaaccttgacaacagaagtgtgccattatactcttaaatgttgcatgatggcctagctttgaagcagactaggatacattgaggtaagcacactagaaagaaacatgggttcaaaactccatgctcaaattcttttccacgtgctagctatgacctgggcaaactctgccctctttagcttcaggtttattatatattaaattagggaagtaatgtaatataccttgtgggattattcagtcatttattcattcatcaagtaagtacctaactaggtattcagttaccaacaagacaaagcctcccccacatggagctgagttgaggtgacatttctcccctaggatgtgcgtccaaggacttcagttttgcgttcactgcagagtccccaacaccagcacagtgcagaataaatatgtgtaacaaatattatctggatgaacaaagaaccaaatgcagacacaaattcataagctatggcaaaaaaaagtaataagaatgagacaacacatgctcagagctgggcccagtggtttgtatgtcaatgttacccaataacacatgctgaataaatcaaaagtggctgtaataactattactgtgagctcgacaagcttgcatggaaattattactagtgttcagtggtctgaaaggtcaatttttaccaaccagataaatgtgacctactgcatatgaaggactaggagaaaccggataatgagtaaggcagagagcacatgcagaaagactcagcgtgctctgaggaggagcacgctgcttcctaggcaggacatgaaaccaggctttaaaggaggacagaaggtgaacacatgaagacaggaaataaaggagaagcaaagagcatgtgaagtggtcaagaggtaaggaatccagaccacagttagagaaagcagtgtctcaggtggctcctacaggatgttgtatacaggcagctcctaggggttgttgtgtagcagtttactccaagattaaaaccttccacattggagagaagcccattaagacacagaatgttagaaaacaggtgaggcaacagggacgttctaaggggaggtgaaacaatggagaaactcagaaggctcaggaagtgagcaacccaggcttcaggaagtccctgaactcaaccagatgcactgggcccctccgtcagcaagaatatataagctgcaagggctgcttggagattttctctgacaagctgagttgcctggaagaggctgagagtggtgccaagccacctgggagaagcagagcactgcctaatagaagcgaggtcagtcaagccgcctggagaggcccagaccacacaagctgcctgcaagagactcttcgacctgttgagctgcttgcaagttatgtggtatgctccaggtttcccatactgttgcccatactggttcattcagtgatagagctgtctctgagtcatttttgttcctgtgagcacctctcactgactcatcatttctgtaagtaaccccagtaaaaccctctggttcacagaactggatcttggtggtgtccatactttagtcactggatccctatctggggtgaaaaggtgtttattcatgtctcctcaggaacagtgtcacacaacaaaagtaaaggtgggaagataaagggtttaaggttctccttggctacagagaatttcagacaagccttaggctacacatgagaccctgtttcaaaaccaaaataaataacaaaaacaaacaaacaaaaaaccctaaaacaaacaaaaccataaaacagaaaaagaaagtttgaagaggtacagtggacatcagcagcctccagtgactctgaatgaggaatggacgaattctataggcacttggcagtaacgtgacatacacaataaagcacaatcaacagcagagccatagaaaaacccccttaccctgccccttttacctagaaacatcgccatgagcttcttatcctgaagaagaatggctccttttaccaggtactcaaagtaggagtccacaccggccccaatgcctgcgtcctgggccacccatttgccagtgagcacgtctatgtgattgccaacctaaaagagaaacacaaggccaaagaatgctctacctagcgctctgactgcccagtgagatgccaggcgggcacctcagtgtctctttaagacatgcaagtgtccagtagatagaaaagctggaggggaagtgacacttcatcctttggacactagcagattttttcatcataacttccaaccagggaaacaaagcccccggatttgtttttgctgcttgagtctggtgattagtttgatcattccttgtacctaaacagtgccattttgaaactggaatgcttattctatgccactatatattgtatatatgtaactttttattttatagcagcttacagttaagagacttcagaggtgttggaatcttcaaagactatggggaattttaaagttagactatattttagattgtgagcaaagtatggaactttaggggaagtcctaagagtgatgtctgtgtgtcaagttgacaaggattgaattgtgatactggatactgtacaaccacatgggaagggactttcattgaaggatcgtctaggctgcactagcctgtgaggatgtctgtggggtgttctctagatcactgttaattgagacagaagacctgcctcctgtaggtaggacttctgtctaagaagaggaccctggtctgtatgagagaacagtaagcaagctgagcacagtaaacatgcacccattaattcattgctctctacccttgtctggggatacaatatttaagtatttaaaaatatttcaaagccacttccaagttcctactgcactaacttccacacattaaaccctagcctaggattttgtgtcctcttgcacatttttgtcacagtattttgttccagaaacagaaagagatgctaagacaatcatggggcactatcctcttatatattgtgaggcatggccatgaggctggaccacagctatcccttctgcacatctctactgtggagagacagctcgtgtacctttgaaaggactgacttagcatactagacaaaaaggaagagagaatgatctgaagtattcacgccgtgcttagcgtgagtgtagaggagagatgagaacttgattctggaatctgtctcagactcaagacaccagtttgtgactccagtgtctaaaaatccaacacagcggaacatgaagcatagcagaagggtatctgcttagcatttgcaaggccctgggttcaatccctagtgtcaaaaagtcaaaagcacatcagctcacacacacacacacacacacacacaacacacacacacacacaacacacgcacacacgctcagttcccagccacagtccacatctcactatagctaacagattttttaaaaaatattttatttatttattatgtatacaccattctgcttccatgtatatctgcaccccagaagagggcaccagatctcataacagatagttttaaagttggattattattattattattattatcattattattattattattattggtttctcaagacagggcttctctgtgtagctctgaagcctatcctggcacttgctctgtaacccaggctggcctcgatctcacagaaagcctctaccacctaagtgttgggattaaagtcatgcaccatcaaagcctggtgatttttattattttttaaattgagtattactattttcattctatatatgtctgtctgtgtgcatgtgtgtcacacgtgaatgttgacaggccagggtgcacaggaatggtacaggagagaggggtacagacagggtactaaccaagtccaccacagttccaaggctggagctaaatctgcctgcattggactaaagatgctaccatgggcctctaggatggcatctgaagggatttttctgaatcctcagacaagcttcactctctaagctgacttcacaccaaactttacataaaatcactttcaaaaacacaaggagctgtagtgtctcagcatagtgtgccttgtttgtggtttttgtgagtttctatgtgtaacagtcctggctgtcctggaacttgctctgtataccaagatggcctcaaactcatagagatctgttgtgggaatttgaccattcagtctaatgaccaatggcatggagagagtcgcccccctaggtctctgagagtgaccccctaagaagcgtgagaggagggttgagtgggtctcttggcgtggaaggcttcctgacgctacagctcagtgacctggtccagacctttccccatcctttcctagtggacaaagaggcagcggtggcacttcatcctgtattggtgagtgtgttatttccatttcatcccttaataaataagtcttcatcctagacttccagcagcatagcttttaacacacttacatcactgctgggatatctgagaactggaggctgaacgatcttgaagcagggccaggacttgcatctaggctgaactgaacccagagttactgtcctgactactctggatcaatgactattagtgtcactggcttatcccttgtgggatgtgaaattagatttggggattagctggtccagaatgttaaatatccatttgttaataggaactgaagggaaaatgatgatctggggtcaaatatgcttgggaaatattaagcaaagctagagactcctttaccattgcatttaataacttttattctgtccaagttctttgtgactctaaaggaaagcaaaaacaaaaaacctggtaccatatgcaagaattccctaatttaactgttcaagaattttttttttttcatagaactcaacatctctcagtgctggtgttctagaaaacacagttttgcaatgccaatagtcattggaggccaggtgaactggtaatccctggccagtgagtcaggggtgtgaagtatatgactcctgcctagaagaaagaaaggctcaaagtacaacatagccctgttccaaggatgagcaatctggctctcttccctcttgtgctagccagttttatgtcaacttgacacagctagagtcattttggaagagaggacctcagtgagaaaatgttcccactgtgggcatcttgacggaagattgatgcagaagggcccagctcactgtgggcaacataaccccagggctggtggtcctgggtgctctaagaaagccagctgagcaagccatggggagtaagtcagtcagcagcactcctccatggcccctccatcagttcctgcctccaggttcctgccttgaattcctgccctgacttccagggatgatgggctacaagatgtaataaacgctttcttccccagctgcttctggtcatggtgttttatcactgcaacagaaatcctaagacatctctgtggcaaaatgtaaatggctcagtctatttttggtatcctggaccactcctacaaacacagttaagattcctttggctgacatctaactcattccttagacctctgggtctcataaggggggtggggggcaacacagaagccttagctgacacaagaaaggcaactgctgacttaccagcccaatatctgaccggctctcccagaggcgcatcagggccaatctggccacatcttcaaacacagggtcaccagtgaggctgctcagggtggcaaattccacaatgaaggtcccaatgcctgctgtacaggtaacaggggtctctcctgggttcacaccatgaagcaggttcacagttccatagggcatgcccgtgggggtctgaaatgctaaaccatcagaaacttatgattttaggtcaaaggagagtgagatgggtgggttgatgatagacccaaagcttcaggcttcaatcagccttcttacttttttcctaagtaattgcttgtgtcagagtcagagaaagatgtgtctcgctgtaggatccttaacccagatgcagacaaacactgtgctatgcaacctttggctcccactgtgatgaggtgacctgcagagagctgagctcccagctgccacactccacaccgcacacaactttttatttattttactactttatcttcacactatgccttccatagccagttagataatggagtgtgaagtaggcaaggcttatgttttatgcagtactgaggccccactggtaattactcgtagactctcaccaaacaaaacagatcagtagaggggtcaattttagatccctgatttaaataaaaagttcagggacaaaatattattgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttattattattattattattattattattattattattattattattttgagttttcaagatagggtttctctgtgtaacagtcctggctgtcctggaacttgatcggttgagcaggctggcctctaactcactgggatccacctgcctctacctcccaagtactgggactaaaggtgtgcgccaccaccgcctgactgacaaagttatttttaaaataaaatctaaaaataggatacaaaccaaaccactgatactatacaaccccctactttcaggtaggggaaaatcatgcctgtaacaagtgactcagctaaaggtcacataggagagtcacactgagggagttggaaatgactgtcctgaccccaccctttcaaatccagcccagtgctttgcctatcttaccccatgccttctgagtccagggaagaactcaacaatgagcctaacatagaaatttcctttccagccacaaggcaagagacagcagagcagtctgcacgtcaccaaattgcaaactaatctgtcaaaacttctaagcgttacaaggtccagacactttgtctgcaggaggaatgaaacctgctctctgacacacagcaagccaggaggagtcataagcaagaagggctccggagtattttagggccaggcaggaagttaaaggaagggtgtgagaatcctctttcttgacctacagaggagatacatcgctgcaggcttaataattactcaatatgaactttagaatgcgtgtattactcagtaaaaataatttttaaatgagaacaaaacagaaggcgcaataaggcagttttctccagggatgaatcacacaggacatgatgtttgtgaggagacacgtggccgtgagccatgggctataagacctgagcccagctcaccctctttgcccggccctccccagggttgacagacaaataagtgagatggccaaggagccagtagaaggcacacaacagcagtcatgtgtttgggtgtgaagagccctagacttctaccacacccaatagggaacacagtgtccagctgattctgctgagcccaacgttgatgaccccactggatacaaacacggaggcttggctcatagttctgaacatggcttaaccaccaaaaccaattcctgccatctgaagcttgctaagcatctgctgtctaaactcagcttagccttccaaaagatacatctagcaggtacgaattacagttgacagagaaactgacccacgggaaggagagtgacatggcctagatgctgggtggcagaggaaagcctagaacctggagccctaatgctcagaccatagctagtccctggggccctcttattctggtagcatgtggcctggggggggggcaagcgggctcactcaaaataaatgcaagggccatggaacctgtgagactcgcttttggcctataccagcaaacagtagtagcatcagcgtagccatcctgggccaacacccccagcaagcccttaaaatgcttagaactcctctgactttaatagtgagaactctcctgatttctatagtggatggcttctataggggcagaaatacagattggaggtttttaaaaaatcaaaaatcaggggaaaatctcaacattgctatccttatctccagcaagcaaagtaggattagagcagaagtgtggtacacacctgttaactcagcacttggaagcagaggcaggactataaaaagctcagggttgagccttgactacccagtaagttacgggccagcaagagctacatactgataccctatctcgaaggaagagaagaaagggggaggggctaaaagaaaactgtcatcttccagtgcccccacccattccatcccacgctcctacccctcacctctgccccatctctgcctggctcttacctgggaggagttttcgggctgcttcctcagccatcctgaggaggggtccagaacagggccatccagcttctacttccacaccagccttctttgacagcagatgagcagagaggagccctcctaccactacagatggcacaaaacacaagggtctcatacaagagatcctaccttgaaaaacaaacaattctattggtttccatagtgccaaaaggtgatatacaagccagagaaaatagatttacccagcagaggaccctgaatgctacgactcttacctgtccgccaagataagtccacaggggtaatagcagcatgactgctgtggagcaaccagccactttgtgactggatctgaggtgtgctccaaaggaaggaatttatgtctggtattgtacacttgatcaaaagcccacggttgggaaggtcaaaggctcctagtggggaacctcatactgttgggttgatgaatgaatggacatgtcaaactgccttctaaatagttatttgtgtacccatacattagtgctgcaaaaaggagcttctctgaaagttatcagtatgataatgttccacttattctcaatgcagagaatcataactggccaaagtcctgagagtaagtgactactgcgtgagtgcccagccatcaacagaatgtctatattgaactccctcaaggccaggaaatgtcagaaaagggactggaatgaatgtaagaggcaaaggatggagagcagtgctgtgaatatggcatggtcactgcactcgtgaactcacagcagctatggttatctgtacaagatcaggctggtaagcatcccagcctgaaggggacaggtgctcgtgagcctccatccctagcggatgaaccactggtaactggtggctgcgaggggtttggccactggtaggttgcccatgctccagtgggtgaccacactcatgtgcaggcagcatttactagatatgaaggctggaagaggaagtactgggggtggttctggatccagtgagaagagggattccagttgcatatgaccaaggtacattgtatacatctatgaaattatcaaagaattcattttaaaagtgagttacgtacggtatgtgctgccaagtatgacaatgtgggttccatccccaggacccagtagtggaaagagaaaattaattcccccaagttgttctctgatcacacacatgctacgtcattgtgcattcacacacatccatacaataaataaataaataaatgtactacaactttaaaaaataaaatactctaaaacagtgattcttaaccttcctaatgctgcaacccttatatagtccttcatgatgtggtgaccccaaccataaaattactttcgctgttactttataactgaaattttgttactgttatgagttgtattgtgaatatctgatatgcagggttagggtgacacccccagaggggttgcaacccagagatcgagaaccactgttctagggctggagagatggctcaaaggttaagagtgggggctcctcttccaaaggtcctgagatcaattcccagcaatcacgtggtggctcacaaccacctgtaatgagatctggtgacctcatctggcctgcgggaacacatgcaggcaaaatactgtatacataataaataaatctcttttttaaaaagaaagagatgagaaccactgttctaaaacaaacaaagatcattccttaatcccaccaattttttccctttgtgggtgataaaaacaatggccactctttgaagtccccagtacagaccaaaattcaggtactacatcccccctctgcagatacaaattttaaggttctgagaagcaagtggcttgccctgggtcacctatgtgacaggtggtagacatctgtctcacttcagtgtgtcactcttctgtcacctgttgcccgtcagggggtgagaagacagctgtcattacccctatgcgacaggtggtggacatctgtctcactgcagtgtgtcactcttctgtcacctgttgcccgtcagggggtgagaagacagctatcattacccctatgtgacaggtggtaggacatctgcctcacttcagtgtgtcgctcttctgccacctgttgcccgtcagggggtgagaagacagctgccattacatcacatgatattcaggatgtacaacaagacagagatcctgtgactggaaataaggctgaccagataccaggaagtgaggaagtgtcctctgacaaaaaataacctgagaccctgagctttagttttccctttctcctggctaagaagaactgaggaaaaggcaggactgggccaaacaagtcctctgataagaggtctctgcatgaagcgggccctcaaagaattatacattctatgtaagaatgaattaagaatggaccttgcatacatccatgagtggacattaggaaaattacaggcctcaaacactggaaccaagtcaaagtaagggggttatgtgagagccaaagttatgttttaagttttaattaagagatccgtgcctaagagagccatgaaacaaaaatgtcactgatctgcaagccccttgcccaaggacagctttacttcctgaaatgctggaggttgttattaatgggagataataagccacttccttttgcacccctaaacaagttcatttgactccactgcaccagatgcacgtgatcacacataggtaggaggtacaaaggcaggaaatatgtcagagtatatgcttgcccctgactggatataggtgccatgagctggtggaatcaaacctgggtcctcaaagaattcattttaaaagtgagttacgtacggtatgtgctgccaagtatgacaatgtgggttccatccccaggacccagtagtggaaagagaaaattaattcccccaagttgttctctgatcacacacatgctacgtcattgtgcattcacacacatccatacaataaataaataaataaatgtactacaactttaaaaaataaaatactctaaaacagtgattcttaaccttcctaatgctgcaacccttcctggatataggtgggaggtaaacaggcaggaagtacatcaggatatatgcttgcacctgattgaacttcatggaagtatggtggtggccttatgggtttgtctttataaaccttagcaaaatgtgactcaagttgccattttctgggactcctggaccagtcctgaccagagttcatcaccctggccagtatttaattaaagctcacttcaaatttcactcaaaaattgtacaattggtctttctcaattctcaggtttaagagttaggaaaaaaaatccccaaagaggtagtgattatccacaaattttacagtctgaattcacatgaactcaatggtctagaaaacctcaaaagttagcataagagttggcactgtaggagcctggaaagtttggggttttgtagtagcagagatcaaacccccagcataaagaggggctttgtaggtagtacctcaagtcacatggcagaaatcaacaaaatgtatctggaaaaaaaaaaaaaaaaaaaaaaaaaaaaaaaaaaaaaaaaattttgaaaaaaaaaaaaaaaaaaaaaaaaaaaaaaaaaaagctcattccatccaggcctctaagaagccaattggtgaagtctaggaaatgagcctatagtaaataatacaaataagacttttaaatcacaaaagcatgtggaaacaaagctcatgaataacaacagagaagggtgcaccaccacttcagatgctggtgttttcactcagagaatggaaaatcctcatgagaaatatacttagagaaatgaaaaaaagtgggtatagaaagacgaagcaaaaaaaaaaaaatagtaaaaaagattgaccagtcatatttacaaaaataccatacagaacttctaaagataaaaacacaataattataagtgaaaatcacatgatttactagtacataaaccatacctgatgaaagacctagcagactagcagacagccaaggttaaagttatccaaagtgcaatatgaagatacaaaatggttcttagatacaagagcaatttaggggacaaggtgagaatctagttgaaaccaaaataggtaaaatagacccaagaatcccaagcaagataaaaagaaacccacattgatatacattaataaacacattgttaatgtatatattgcaaaacgtcaaaaagagataagatccttttttctcactttgttaccctaaataaaacattttaaaagcagctatagtctgggtgacaatgggtgatggctgctggactagcttctcagggtcatgggtaaaattacttaaaattgtccagaataaaaataattttaaaaaggacagatacagtaaaaataaaaaacaaaagcatagttatttatctacaaagaaatgaccatgagattgatggattatttcttaacaaagtaaaagcaggaaatagtggaaaatttctttgatagactaagcaagagaaaataatcattaacagtggccatacatgcagaaaaaactctcccaaagaccgaaaggaagcgagacaaagacattttcgtgtaaacaaagcctgagaaagtttgccaagagcatatccacacacagggaaattctaaggttctttagagaaaagatggattgcacataataaggcctgagtcactgaagctaagactgtcagaaaggtggtaacagggctggggagatgccaaagtttgtaaagagtttgccctgtaagtatgaggatctgaatcctatcctaatactcatgtaaaaaagtgaatgtgatggtacacacttgtaatcacacacttgtaatcccagtgccgaggaagccgacaggagattgctggggctaataggcccgccagcctagcatagtcagcaagccccaggtcctaatgagagaccgaacatggaataataatacctgataaataataccaggatctgacctctggctatacacgtgcatgcacacttgcacaaacacacacacacacacacacacacacagtgggtggggtggggtgttaaatatgtgcaaactaaaactataaagtactaaaatatggaacatgtctatgtctatcatttaggaagagaatagagatttttcactacttctaaactttgataagttatttgttctatttgctgagacactagaagataccatgcacaatttcaacattaataagaggaaaatgaaaactgggtgtggtggctcatatctgtgttgtcagctagagaatggctttgactttaaggccagtttgtactatgtagtgaattgtaatacggctttggcaacggggtgagaccatgtctcaaaacaaaacaaaacaaaacacaaaacaaaacaacaacaacaaaacacccgaactatcatggtgtagtggtgcatgtctttaaacccagcactagggaggcagaggcaggcggatacttaagtttaaagtcagcctggtctatgcagccagtttctggacagccagagttacattgtgaagctaaatctcaaaaagtaaaaaataatgaaagaaaataaaccaaaccaaaaaaccatttccatccacaaagataacacaacctccacggaagcagttacacctttcttgttccaacaccaaataaatgctatttactctgggaagggggcagcgctgtctgtcactagtctggaccagtgtcctggaaaggtgactcctgaagacctcatttaccattctagttgtcagagacaactccaatgtcctttcatgcaagccctagaaggtggccctcacctcggatgttggtttcgaacacagaggcgttcacgtcgatatcaaagtccacgttgtcctggagaacctccaccactctttggaattcagaggtattccccaaaatctggaatgaaagagtaccctgaccacacagctcccctaagcatggaagcagttcagatgctggtgtggtcttcacttttcagtcagaacctctctgtcctgagttcagttacattatgccagcattcatacagaaacccctagctgagcaatttcctggtccatttaaatggatcccataaaaataaagcagggatcagtagtagacaccagctgtttgtagctcacttgtcctttccaccttatgcaaaacagtatcagttgcttcccaatcttctttaccccaaagcctcctgccacagagcccaagcacccttgggttcctttacttcaagaggtcaccgtgttaccatactgtgatccttgtaacatatacctctgggaacaaatcttttcctagtaacagacacggccagcacggtttttacctggccctacttttctgacttgaaagcagacatgatttctgtagggtgacagctatgtttcaccctggggtacaaagcgtgagaataaaaccctaatgacgagaggaggaagctacaaagagcccaagtctctggtgacatagctgagtagctggctcattactaggaaaaaaaaaaattacctcttggcttcctttttcctttctttctctttttgaaaactttattttattttgtgggtttgagtgttttgtctccacacaagtgtgccacattcacacttcgtgcctttggaggtcagaagcggggagttgggggctggagagagggctcagaggttaagagcaccaactgctcttccagaggtcctgagttcaattcccagcaaccacatggtggctcacaaccatccgttatgagatctggtgccctcttctgatgtgcagatatacatggaagcagaatgttgtgtacataaaaaaaaaaaaaaatctttaaaaaaaaaaaaaaaaaaaaaaagaagaagtggggagttggatctcctagcactggagttgtgaggcaccatgtggatgctgggacccaaacccagggctcttaaccactgagccatctctccagcccccaaacgttaggcttaaaggaagggtcgcattttcattcagctttgtggttcttctccatttgaggttggtggggattgaacccatggcctcatgcatgaggcaagtattctatcaactaagccatatcctctcctttcttttacccaggaaaagaaatctctgtttaaaccaccagccaaatgctatagataagtgtgtctacatacacatatatggtgtatatagatacatacacggaaggagagagcgtgtagggaagagagaggggggtggagagagaggcggcagggtgggggggaagagaacaagcttgtttgaaatgttctcatacagtccatgctagcctctcatacagcccaggctagcctcaaactcactacataaggcaacaatggccttgaacttctgatgttcctggggttgtgacaccatgactagcttgatatataatagtgatttttttttctgctaatatcacctcaaattccccttgaatactcttcctcccatagtgatcccaataattcaggagagggggatcccatgtccccagctgtggagtgggtacttcagtgggaccagccaaggtaccacatcccttccccagtgagactgtttggaaatacatatgtgatccaaatctgatcaatgaagacttactccttggatgaatggaaagggtgattctttgaacgtaactgtttcttaaactaggaagtaattggaaagacaataggctgacctatggcttatgaagactgagaacacagcagccaagataaaagacagagataaaaggtgaaaggagactcctactagcgtcattgtctgtctggatcaggtcgaaggccagccttcatctagactttttagttatctgactcactaagtttgtcttcttgcctaagtcagttgaattgagcctctgcaacccaaacaatttctgactatttcaacactagagctcctctaggactgggaaccaacctaccttctggcctctctctctcactgttcaccttcatctgcagtaaaactgtgcccatttttctccaattttctactgttttctccataagaagtcaagtactcatagtcttccatttataaacccaactcatcactggcgactgtcacctgctctacaatgcctcttttctttctttttcccttaagaaccctatgaactccatccatactactgttagggtctctctttctttctacattaaaacaaaacaaagagacctttgaaatggcagaggcctcattcatttttgtatttccccaaagtgcagacacaggaaaaaattacttgacaaatgtttgttggatgaggccacaaatctttcttcacattgcgtcagtgaaatgtcaaagcagaaatgtcatcacttccttatacttaagaaatgccagtggctcttctatactttcaaatgaaagatcatacacactgaagaagagcttacagtctccagatcccacataacccccagtgtcacttgttccctcctctctccccatttccaatcaatgcttcaatctctgctgccacaaagcctttgcactagctggcctggaacaacttcttccagcactttcccagctaccaccagcttcttcaaattccaactccagtttcatatcactgcttcagagaacttctcccagcctcctcagtctaggtcagatcttttttttttggggggggggtttattttgagacagcgtttcttctgtatagctctgactgtcctggaactcactccataaactaggctagccttgaactcagagatcagcatgcctctgcctcttccttccaagtgctgggactaacgggtgcaccactatgcctggccagatcattttttgttagggtctttccaatacaaagctctggcctgagtgtgtaattatcatcttttatggctatcatttgattctcagtgtgtttccggtgctaacatctcaagcagaggtcatttctgtttaaactcatcattttgactccaaagtttagcaccatgcttggtgcatagtttccctcaataactgtttgatgaatagttaagaacatacaaattaccagtaaacaaaaattataagacaaaccatatctatgtagtgttcagagtcacataaatattatagatgtataaagatgagaagtggccaggcatggtggtaaatctcagcacgtgggaggctgagacaagaggactgccaagtttgaggtctgcctggctaaacaacaaacctgtgtgtggtgcacagaacagaagacaatcaaggattggagtcacacaaaattaagtttaagtctgagttccacttttagctttctaagcatcacatttcccagctataggaaataataagaccataagaattactggaaggattaaatgtgataatgcatgcattgtaatttgagtaagaattaattgtgacaaactgtgtagaagcctaggttcccagcaggtagcactattttgagaggttatcgaaaccttattaagtggacctagctaaaggaagtaaatgggaaagggtccgggagggggggggtgctttgtccctgaccctcctgtctcctgatctctgtttcctatccaccatgagacaaagaagcatgtctgctacattattgcccaagcacatggggctaagcagccatgtactgaaacctctgaaaccgtgagcctaggtaaacccttcctccttttgttctcttgtgtggccatagcaatgttaaacaccaactagtacaacctttaaaggccttagcacaagccatacacatgacacagtaactagtgctgttatcatcattgcacatggcggatgtcaaagtctttgtgtccctcactgagctgtgcaagtctatcacaggtcctctataaatatttgctcaatgactgaacctgtgtaagttggttttctcttggaacttggcattctctcctatgcaattgggtaaccagagcctggtggctcagaatcatgagataaagacctaggggaggaatttacttcttacccacagacaagctaccaaaagaggaaggatgttggttgggcaatgatagagagggaaagaaataggataggatacttaccagcaaggtgtccagggcatcaattagcgtcagagagaagctgtaaaaagacaaagtcccaactgcttcataagaacatcaaacaccagattcataacttcccagatcagattcacccaaaactcaaagaggcccagtgatgtccctatctatcccatgtatagttacaatagggaaaccagggggaaaaatcagagccctttgactacctgatggagctcaactgtaattaacatttacctatgtttcctggcattcttctttaccatggaggggcagtacaagatcgtaacatattaaaagttagagaatgctcaaggctgtgttacttaacatcaaaaagctagaaattactggctgttcacaagttgaagagtgctgaacaaactatgatacaaacaaatacaaatctatgacattattaagacatggttaccggaattctgcatactaatgagaagatcatgctgttcaatgaaaaacaccatatattaagtaagccacataatatgttttcatctgcacttcaaaaaaagaaaagccacattagtggctggacaggtggctcagtggttaagagcatttattgctcttgcagagaacctgcatttgattcccacagcaacatgggggctcacaactgctggcaactgcagttccagggactctagtcaggagccttcacaggctcctgctcacatatggtgcacctaaattcatgcaaaacaaacacacataccattaataagatttaaaagagtcctactgacagaaagcagatgtgctgctgttagggccagtattagtagagaaataatttataaggtgtgcttgggaattttttagggtaaagaagtattctagggctggagggaaagctcagaggttaagggcactggcagctcttccagagaacctgggttcaattcccagcatccaacatggcagctcacaactgtctgaaaccccacttacagggatctggctctctcacacagacacatatacaggcaaatcaccaatgcacattaaaatttcaaaaaaaaaagtattctatatgctagttgtggtagtggttactatacatttaaaataggttattttttatatggagtatataataagctactttttttttaaaacaaagttaggctttaataagttaatttttttacaaagatagccaggtctggtatatgcctgcagtcccagcactggtaatatggctgacacaggacacagactgtgctacatagcaagatcctgtctcaataaacaaataatacatctatgcacatgtgtctaacagtataaatgagaatactcgagaatgccatacaggacaggttgcggtgccagcgttctaaggaatgagagacaccaagcatgactctgtactacttcaatagccatttgcttgtatttactttttgttccaactaaaaataaaaaatggcacaagttcttagcttacttgtctagtccttggcatcagagagcatgctatcatttataaatatttgttaaacaagaataacaacccagaagtgatggtgaacacctgtgatctcagcacttgggaggtggaggcagaagcaccaggagtttgaggtcatcctcagctatgcagttgagtttgaggtcggcctgggctacgtgggacacacacacacacagacacagacacagacagacacagacacagacacagacacagacacagacagacacacacacatacacacacacacaccccagccctaattcccaggagtggtaagagaattaaatggggcgactctgaaaaacatgtggcacagtgttcagtttctgtgaatgcaaggattcttcactcagctgggtttttattctagtgaaaatgaaaaatgtgacaatacaagaattactaaaagaaacgaatcaggtgacttgtttgcatggtggtaggagctgaatctggggaggtgatagagagatggtcacatgaaacagtggtacgaagatggaggggaaatatttttcagtcatacggagaacaccaactacaaaggaccttacgtttggggagagtaacatcccctcctggacctgggtgtccacctataaaatgaagggagttgagttttctgactcttgggagatctttcaaaatattctgtgactccagaaatgtccctaagtcttcgtatgtggtgcctgttcctgcagagggtgagcccagaggtctagcctgccagattaatccaagacttttttgtactgtgaaaactgtatagactctgacagtgctggtttggattgaggggaaggggttgcatcagcccaggccggaaactttccagaatcagtgagacattgaagccaccagccctcctaggcccccagccaacccccttggccctcaagctcgctctacctgccccaggtgtcgtgaccgtcacaggtgagaggtctcagctcatcgtagggaaaggcattttccaggtaactgtcgtaggcgtggtagaacatggccttgactcgctccctggtgcgagggatgagaaataaggtagggggccagaacccaaaagcaggcgggagaaaggaccagacacaggacggagagtgggaaccaccatgtgatttccgctgagtgcccagcagcgggacccgagcacgtcagggtggggtcctggggcggagggaagggaaggggcccggtgggcgcttgccattccccagccgtggagagcaggagcctggcccccttcacctgtagtgggcggggtcgggcgcggtgccgtcggggcctggcgcaccatggtgcaggggcaggaacacgcacacgaggccgagcggaatgagtagccggaaaggcatagagctcgtgtcctgtcagtgccgccgcagcagctgcagccaccgccacccgctcatcctccgagccgctgctggttcttccggggatacgcaccacgacgcctgcgcgtagggcaataagccactcacttcctgactacaagacccaggatgcaatggaacccaggcaaaagagcatctcgggatatctgctctacagagaagagttcaacgtgtcttaaggacagtggctgctgtggctgctggtggtgatgtttttcttagtcccaatttccgtttgttgagcccttactgcgtagtaaagcgtcaaggagcactttacaggtgctgtctagtttatttttgtttttttccccaaatacctttttaagaaggggccagcaggaactcagaattagagaagatgtctatataaagatggatgaaaaatgatcagctttaaccattattaggcacagggtgtcccaaaccacttctccgatcgtgtaaataaactctagaattattctcccaaaggcatcactcttaaggtttgcagaaatcccttttgttctaggaatttatgacatcatggtcccttcagtctctaaactgaagtctctaagcattttgccagtcccagtaccccggaccatctcagtggctatagccctctgtcccgagtgaaaatgaaaaccctggcactattgctttgagaacattcctttctttctaggtcctagaatttgtcagcacgttagccacagcaacacccatcttggcagtgtgggtgagctatatagacaaccctatttgaagttacatccggctttattactactgtaccgttcacacacaacctatctacataacccaaaaggagtctttcccctcctctgggcccagcaaccatgcttataaaaggaaggatttgattaaacagatctttgagatgcctttaatttagacttttaatcctagggttgcccacctcttctttgctgaaaaagtcagagggaaatggctgttcagtttattgagtgcagtgcaggcaggcttggcctcctttggcccaacattctttttaagattattgtttttgacaatttcatacatgtatacaatgtgttctggtcactggccctccccattgccctccatcctcctctgctctggctgaatctcttctcctcagcaagcccctcctacttctatattttttgtgttgttgtttgtaacacaataaagtttagttggggctgctcgtgtgagcacaggtgaggagttatgggtaagtttagagttcagcataattttgtgactttattaagttgtggatatgagggttttgtccacatgcatgtctatgcatcaaatgcatgccaggtcccctctgaggccagaaaagggtgtgggatcctctgggactggaattacagacattgtgagccttcttgtgggtactgggaattaaacctaggtcctctagaagagcagccactgttcttaaccattgatccatctcgccagccccaatccagcattcttgaaaatatccctcagtaagtgtcccaaagtgccattagttgataagcaaattaaactctgtatctaacctagagacactgaggttctctctctctctctctctctctctctctctctctctctctctgtgtgtgtgtgtgtgtgtgtgtgtgtgtgtgtgtgtgtgtgtgtgtgtgtgtgtaaataggaaaaatattaatacctgtttaataggattgggggggggttcagtaaaccatgtaaaatgcctataacaccgctatagaaaacattgaataactaggagaatattattggaaagtgtcatggaagggccagatagaaagaagaccacaggaaactgagacctgaaaaacaagacagggacactgtatgtgtttcccaagatatggtaacaaattattatcaacttggtagcttaaaacaaaagaaatttattctcccatcttgtcttagtttgggcttttattgctgtgaagagacaacctcttgattggcaggcaataggacatcaactctcacactgagggaagcttcaacaacctcccaacctagatcacaatatcataaacgcagtgaggggtgaagccagaacagaagaattctaattcttttcaggagtaaaaaagaattttttgtctcatcagagaactgtgaaatcagtcacagaagaatcatgaaaatgtaaaaattggtttgttcattcagtgaatattgaaaagctatgtatttattaaaataggaaaagaaaataagaacctcaaccatttctgttttgttcggagacacatatttccaaatccaggcagccttgtcccaccctccctgcaaatacttcatctacactagagttctgaataggagacaaaaggctaagctacagggcttgtaacatggggaaaggcacttggctaagctgactttcataataaaggcctacgcctgaaaaatactttgtgcaaatataagataaaaagtagccttctaaccaataataatgagttaatttaagttttttttttttttaaaagaagctagctagaaacaagactaagctaaagccaagtatattaatggtcagtctctgtgtcatgatttaggggttggcagtccaagaaagcctgccacagtcatgtcttcctgtgggaaaagagagtttggaaggcacttggatcataccagtagccaaaagcattgaccttggacggtgtattgaatagagtaagcctcatattaataattagtaggtcttggttctatttctagtttagccattgtctttgtgtgattctgggtgagtcactttcccttttagggacttagtttccatatgtggaatgcaaacgaatgagactacctctcaatatatatatattttaaaaagttagcaaatacactcagagttattgcaagaaaaaaaattcagaaatcaacagtcatcaacctcagaaatcccctcagaaacactcatgaagcaaaacacaactgggacaatattccaaacagaatgaactgtttgccaaatggaggaagagaagtaggatgaggttgagcaggaggagtcgggagaggtaaaggaggaggaagacatggctaaatgtgttgcagaagtctttatatagtgatttatgtcttgcagatgtacctttctcagtactttgtatgacatcaatgccattaaccctagcccagcagtattatcaccactttagagatttctttaaatagaagcacaacttttaaaagttttatttcatgtgtgtgtgtgtgtgtgtgtgtgtgtgtgtgtgtgtgtgtgtgtgtgtgagtgtgtgtgtgtgtgtacacatgtaagtgcatatgcccacagaggcaagaagagggtatcatagccggtacagatggaattataggcactcacaaaccaaacccaagtcctctgcaagtacagaatgtctccttaaccactaagtcatgtcttcagctcctcaaagcacaaattttaaaagtcaaagagaggattaagtaaacagccttgtatcagacctaataagctttagagctaagatttggagccaggcagtccatattctaccattctgatgagaataacgaaaggccagttcagaatttaaaagtgtcagtctggtcaacttctacagcatttgatgttgttccagggtcaacattccctacacttttgttggaaagccagaaaaaatgaagtgcagtccctaaggttggaagttagacgcctttggcccatacactgaactttttcagttgagaactagctggaaatcccttttccgggatctaaagttcagaaggttcaagtgttttttctcagctctcagcacagaatttgtccactacatactttccgactgccaagaattaactagtttgttcctgggaagctctccatctgttgtcttgtagaaattcttgcatttcccctgtgcccagcatgtccaaatgttggaatggtgacttcctggccagagtcctagacatgttttcctaacacactcatgtttcatgtgaactcagccttattacagaatctataactgagatgcagtcttaaaaaaacagttaaaatgatataatctgttatacacattttatcagctttttggtactgggcattgaacctagggtcttgagaatactaggcaagcactctgctttgagctgcttcctttcccacaatattaaagaaaaaaattttttaaaggggtaaataagtgtaaaatgactgaatagccgggtggtagtggtggaacacacctttaattccagtgcttaagagacagaggcaggtggatctctgtgagttctaagccagcctggtctacaaagtgagtttcaggacagccaagactgttacacagagaaaccctgtcatgaaaacacacacacacacacaaagactgaataaaattacaggacattccatggcattactgccattgtaggaagattcaattcttaaaaacaaacaaacaaaaaaaaacaaacaaaaaaaccctatttttattgagcagaaagtggggatgccgagaagatattttggcaatgtctgaagcagaggctttctcggttggtttgacaaatgcaccaagccccatatcacatcaagctgaggaggggaggtaatacttttcccctttagccttctgttttgtggctccaaattctgccacttctcgtttgtgcaagaacagaagaaatttttgtagaggaaaaaaaaaaagactctaataaaattctaattctttcaacaaaagcttgagccttgttgttttcttttttaatggttgctgccttttaagctacagctatcctattcagtaactgcaacttggatgctaccagcagctgctgggctgcaagagctggagcctgaggaaattctgttccctcaggcacccgactctttcaaagctactaaggaaatttatttaaatctctgtcccactaaaggactcaagattcaaagcttaaggtagaatcctgattcccagagagcctgaatagcaagcagctcacctcgcgtctcccaagaagttctcatgctttttttcactcctccttataatcccttctccacctggctccttacagcttcctgtcagctagttgctgacccagcctcctgaccgcaggtgaattttatttaatcaaacacatctttgcgtctttaaacaaatgttccagtacataaacaaaattaacgtacctgaaattaatattctgcaaggccttgtaatcacagcttctaggtgtcttgtgagttaaaataagtagtgttaaaaagaacaatgatacaaaactgttcctaaggcaagaacatgattgtcagacatttgcggggcggggagatctgggcatagtggtatacacgtttacctttttctttatttttattttatgcgtgtgggtgttttgtctgcatatatgtctgtgtaccacatgtatagtgttcacggaggcagaaagagcaaccgatcccctggaattagagttgtagatggttgtgagctgccaggtgggtgttggaatctaacctgggacctctcgaagagcaaccagtgctcttaacctctgggccgtctctccagccccatgtgacattgtgatgtcatgataaatcattgaacagcaaatctatgtaagagtctctgaaaccaggtatggtaacatatgctcaaaatcccagcactcaggaggctgaggcaagagagctgagagcataaggccagcctgggatacctactgagaccctgttcaaaaacaacaacaaaaagaccaacaagaggctggagaaatggctcagaggttaagagcattgactgctcttccagaggacctgagttcaattctcagcaaccacatggaggctcacagccatctgtaatgagacctgatgccctcttctggtgtataggcaaaacatggagacagaacattgtatgcagaataaataaatctttaaaaaaaaaaaaaagtctaacaaaacaggtatctatctctgaaaagaatttctttttttatcatcaaggaaagcctagatagtggacaattccagaaactgatagcacagaagagaactccaaaggttgtgttttattgtgctgggggtcatttaaccatcttgcattttacttagcactcttaagtcaatatttttctcttatattgattatgaaaactccgttttttaagttctgttttaagttggatttgtcatcttcctgttctcttcattgatgagttaaatgaacttgtgactcatgcttactttctatttttataaaaatgtcgttgttcccagagaacctaggtaacaaagaggaccccaagagagacatacatggatctgcctaggaaaggtaagaagacaagatcttctgagtaaattgggagcatggggggcacgagggagatggaagaagaaaggggaggagagaaggaaaatgtatagctctattaaaaaataaaataaaacgtcgttgttaacatgctgaagactatccttggcacaaagtaccagaccctgtgatgaataatgtacagacccatgttacccctttgagacagtttctattttattttatttttatgtgtgtgggtgttttgtctgcatgtttgtctgggcatcaagtgtgtgcagcacctttggtggccagaagaaggcatcagattccctggggtctagttacaaatggttgtgagctgccgagtgagggctgggagtagagcccaggttctctggagaatcctcagtgctcttaaccaccaagccatctctccggtcctgagagagtttctgtttaatcctcactttccagataagaagccagaatctcagaaaaataaaagtgtgcttttagtaccaagaggttgactaatcacatttttctaattcttccctagaaatcgtatttgctcattgacttaggaagcatctcttgagcactttaccatgaagctggtactctgccagtctggtgatacagacaaggctgctgccctctttggtatggaagacaaaagcattcaaaaaaagaaaatgtcatgtaggagggttaagaaaaaaaaagggggggggtaggtttctgagaaggaagcaactgattaacagaaatgacctgtgatcaggaagggcttttcaagcttcagtacgaactggtgcgtggccccattgcagcagtaagtgtaatccacttacaaggaaagcatggtcacctagctggaagagagtgggcaatgctgtaaagcaatgagaaacaatggtggcaagggtgggtgggcactagatgacacaaccctttgtaaaaaacagcagggaacttggactttgtcctaagtgttatcaatggattttcaaggggcagaggagaaaacagaaaaaaacaaaacaaaacaaaacaaaaagccgggaggggtaggaggctaggaagtcaccaaggtggtacagggctgtaatccctgcaggtgaaagatcaaggcaggagggtcaggagttccggttaaatgctcagtaaagtgtttgtcttgcagttcccagaatccacagaaaaatactcgaggttagtgagcaggctcagcagacaaaagtgcccgctgccaagcccgacagcttttcccagcctcatgcggtggtaggagagaactggctcccaaagttgtcctccacacgtattttgtgtgcatgtgtgtgcacacaccgtagatataaacgttataatccaattcctttttaagatgttgggtatggtggcaagtgcctgtaattctagctcagaagtgacagatgcagggagacagatgcaggggaattcctgggcctctctggccaattgcctgtgccaagctccaagccaataagaaatcctgtgtaggcagagtctatcccacctgcagctcccaaataaccacaccgaaacttcctattaattatgaaagctcatctgatagcttaggcttgttactaactagctcttacaacctaacctatttttattaacctatctgttgcactgagactcgtttacctcatccatgtactgcccatcctgctcgctctacatctcacggtgtgtctgatttcttcttcccagcattccccctgcccaaaaatcctgcctacctattggccatttagctttttattaaaccaatctgagtaacacttcttcacaatgtacaaaaaagatcatttcacaacaaccctgtcttcaaaaaaaatgtagatggcattcctgaagaacaatgcctgaggttgtcttctggcctccttccatggtactggtatgaatacacacataaacatggggaaggggagacagacagacagacagagacaggagacacagagaaaggggcagagatagctcactaggctgggctacatgaaggtctgtctttttgaaggggagtggtgtgggagatagctggcacactcagggaatcccagcacttagagaggcagagacaggagttaaagttcaaggccagcttgagctacacagtgagacagtctttaaaaaaaaaaaaaaaaaagataactagaaagatgtctcagtagttaagagcatctactgttcttccagaggatgagagttcagtttccagcacccacatcaggcaactcacagactcatataattttaggttcagggtacctgaaaccctctgagggcacctgcatacacgtggcatacatacagagagaaacacctatacgtaaataaatctttaaaaaataacacgaaaaaacaaataaaaattaagccaggcagagtgacatgcacttgggaggctgaggcaagagactcccaagagttagaggccagcttggaacccagtatcagaaggggagggagttcagggggcaatgcgcttgccacacaagtgtgaagacctgagttcagttcccaacacccaggtaaaagccagatgtggagtctggaatctcggcactggggtgggggagcagagacaagcagatccaagggcttgctgcgtagtcaggccaacagattggtgaactctggggtcaggaagagaccctgtctcaaaaaccctgtctcaaaactagggtagaaagtgacagagggggaaaaaagacccagtgttgatctctgtcctccacacataccaccatgggggagtgcatctgagtaacgagttaattagtagcataaaacttaaaaaggaggaaatccactatcgtcatctgtaggtgctgtgtctatccataaagtccataaatatcagtcaagtgttagattaaatacaagttcattgaagttactagatgcaaaattaacacaataaaattgtcagcatctctgtgagaaataagcagtcagaatatgagattttctcaaatactcctttcagtaacactgatttctcacagggctgacacaggaggctcacttgagtccaggagtttgagaccagcctgggcaacatagcaagactctatacagaaaaatacgtaaatgacatgatctggagagttggctctgtggctaagagcacttagtctctggtggaggacctatgttcagctcccagcccccacatggcagctcacaaccttctgtaactttagttacacacacatacccaaacacagacagccatacacataaattaaaaataataaatataattccttttactgttgatgtttttctgagacatggtttctctgtgtagctttgcctgtcctggaatttgatctgtataccaggctggccttgaactcagagatctaccagccactgactcccaagtgttgggattaaaggcattgcatgtagtatgtcaaatggctttggagagaacagatattttcacagtattcaatcatccaatcacaggataaggtctctctctctctctctctctctctctctctctctctctctctctctctcacactctctcttatatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggataaggtctctctctctctctctctctctctctctctctctctctctctctctctgttacaatttctttgacatctcttagagttctataatttcatttctaagcaccttacccatgctttgttagagtttttccttagatagctcatatctttattgtatttaattatttattgaacttatacttatcttaaaagttaggtatgtatgtgtagctgcatgactctatgtgaaatgagctagtcagggatataaagttaaggacttccaagctatctaaaaatatgattaaagagagtgaaaggatagcatgcatgcattctgtattcaggaaaccagggggagtgagtttggccaacaggaatccagggaaagataagactggagaggatggtgggagtcacccaacaccaccaggtacctgtcaatcgctggggctggcagagacagttaccctgacctcctgcctctgttgacgcgcgacccatatgccccgtgctgaagtgtgctgggaactgtgcctgcgcagaacatcctaagacttccagctttctatttctccttcttcccttaaggaaatcacactttattcacatctaacttccactcttcccaagccacagttccactggctgtctataaagcctagctcctttctcacaccccccacctactcagttcccacagtgtgtggacacgcatgatccatacgatgctaaggaagaaagcatgctgggtgttacacagccccacctctgaccatctgggtatcttagcacggctgtgtcctcacctgtaaatgggagttccctggctctgtgtgtgtgtgtgtgtgtgtgtgtgtgtgtgtgtgtgtgtgtgtgtgtgtgtgtatatgtgtgtgttgagaaccaagcacaagggctcccctcactcaacagtctctggacattgtaaacttcctgttggtggtggtccctggttctgggggagtggggtgggcacactcttgttgtggagttgagccaggtagggtcaggtctgtcttcaggacacagggaagggggagtggatcctctgaagtgcagctgggcacacagcccagccttggcaggggcactcctcacccaccggggctgcaccagcactggccccagcctgtttcctgtttcccttatctttccccaacatgtgctctccggggtcagaaacactgccatttgcttccttcacttccgtttgctcaataagacccttatttttcagattctagtcaaatctggctgctggcccagagcccactacagtgtgtgatttttcagcccctcggctccaacggcagcatttctgggtttagatggaaaacttctcaatcggctcctctcagctcccagcttatttacccctactcttctactctctccctcctcagccccatggcctcatcctctttgagttccaattctgcttttagttcccaagtagtgtgacctgtgtgttccctcacttgtcctgtctgtaaagtgaggataatgacctcggcttccccagaggaagtgagcacagggctacgttagaaatgagcatacattaaacagtcaagaatgtcagagtcatgcactcagaaatgtatgttgaggtctgtgtgtgtgtgtgtgtgtgtgtgtgtgagagagagagagagagagagagagagagagagagagagagagagagaaggagagacagaagcagagaaagagagacacagagagagggagagatagagcgagagagacagaaagggggaagagagagacctggggaagtgtttgcctttcaagcatgagatactgagtccaatcccagcattcatataaaaacgtcatggcacaggagcagaagcaggagggttcctccaagccaatgagaggccttgtctcaaaggaaggactgatgagcaagaggtggctcaacaggccaaagtatttgccaggcaaagctgagggcctgaatttgattaccatatgctacagtggagatacagaaccaactttaaaagttgtcctctgactagcacacgcatgtgcctacacatgcatacacaccacacacagacacacagacacacagacacacagacacagacccagacacacacacaccacagacacactaaaaataaatgatcttcaaaagaaaagataaaggaggttatcttagggtttctattgctgtgaagagacatcatgatgacttcaactcttataaaggaaacatttaatgggggttttgacttacagtttcagaagtttagtccattattgtcatggcaggtggcatgcaaatagacatcgtgctggagaagaggctgagggttctacatcttgatccaaaggcagcagaagtagtctgttttccccactgggcatagcttgtgcacaggagacctcagagcctgcccctgcagtgacagacttcctccaacaaggttacctccattcaaacaaagccacacctcctagtagcgccactccttttggggaccatttttttcccaaccacgacagaggtaggtagtattcctgaggatgacccctgaggttgtccttttacattcatgcacatatacacacatgtgtactcacacacatacacacaagtacacaaacccctgcatacacacacatacagatgcattaaaaacttttcatattacagtatgaagattaaattaataaactttggcatcgtaaaaaaaaaaatcccaatgacaacttttgctgtgtaacctgaggtaagtcatttaacttctctgaaccagattctcttagtaaaatgctagtgttgataaaacccacatcatagaactgtcatttgggatagaattatttatgaaagactggacactgcttccagatgcttaaatcaaaggcacgggacacgggaggggagaggaaccccccatcctgtcactggttaaagcatcttaccaacagcaaggaagagctgcagtgcagttaacagatgctcaaggcctttctcccttcctagctatcaacctgcaattttctaggaatgtcaccagaaactccacttacaggaagggacatggactaaaccccttgtgcaacactcttggctcctggctttaccttatcagagtctaatttgtcagaagacctccaaagccagtataatctcacctgggaggactggagagatggctctgcagttaggacctgggttgattcccagaaggcttacaacctttcttaacttcagttccaggggattcagtgccctcttttggcttctgtgtatataaccacacagtgtatatacatacacacaggcaaatgttcatatgcataaaataataaatagaatgtttaaaagcaagagagagaaaaggagggaagagccttcagcaactttatttatttatttggggtgtgtgtatctgtgtgtgtgtgtaaggaacaatagcagctgagccgctcacttatcaaccttttgagatgtaactggagagccattaaaatggtgtatatacagttaccactaaggtagtctgattgtgagtgtcctttgcggagcccagagccactctgtctattttcctttctgctgctccctcttggagaagcccatgcctgtgctctgagctatgtcttcctttcttcttctccttttcctaatctcgcacttaagcctaccttaagattgcttgcgtaaaatctccgtttcatcacatgcctgcctgtcctgaaattcttttcagtgccaaagccatgaagcccggtttagcccaagtcaagatttctaaatatctagggaaacccaggctgccgagggtgacagtgtggatctgggcctccaccccctcaccactgacaccagccctccatcccagattgcatgtgaataatggttgaagtgtgagattcgtttccttcaattccgaaacacttttccaggacgcaaaggacgaaaagtcaaagcgaagagacacaggagctcattaggaatcagcaaaagtcaagccaaattcaagtgccgtgttacaccacccacctggtgctaccaagggctggcaaggatgtgaagctgggaactgcacactgctgggaatgcaaattagcacacatctttgtaaaagattttggcaaatctacccaaattgaaaaccatctaccctgtgactcagcaagtccacgcccaggagtgcagctacacaaactcatctagacatgaggaatcacgaacatgaatgcacatgtcagcactgctcatagcatgcaataaacaaataaacatacatgtcagcatggggagatggctcagtcaaaaacctgcttgcctttcaagcagggggacctgagttcgggtcttcagcacccatataaaaagcccagcctggcatggtgcacctgcaaccccaccattggagacacgaagacaggaggcatcatgggcttgctggtcagccagtcagtaagctccaggttcagtgagagaccctgtctcaaaaaatgagatgaaaggctagggaaatgactcagtggttaaaatgcagaaccccagagctcaggcaaatgaaggtgggcatggtggcccacctataattctgggctctgaagacagagacaggactccccagagcaagctggctagtgagactagctttattcaagcttggggggggggagactaattaaattcaatggagagaagcctcatgtataccagagtcagttctctccttctacctctgggttctggggagcaaactctgtcaagtgtgttaacctgctgagccagctcactgacctcagtctctaggcgactgagtgacaatggaagcatgaccaaagaagatcactgatgtcagccttgggtttctgcacacatatgtacatacatgctccctttcacattcatatgtgcctacatacatgtgaactgaatgtacacatgcacacatacaacacatgaaaagaaggaaaaagaatgagatagagagcaattaaggaagacacgcatatgtacttgtacatatacacatacatacatgaacaaacacaaaaagtaatgtccaatatcagatggtgaataaatagtgatatattcttttcaggtttgtttgactttatgtgtgtgaatgtttgcctgcatgtgtgtctttgtatcttgtgcaggcctagtaccttcagaggtcagaagagggtgttaaatttcctggagttacagactgtgagcatagttaaatccgtgagctgctatgtgggtgctgggaatcaaccctgggtcacctggaagagcagacagtactcttacctgccaagccagctttccagcccccaatggcagtgcccttaaaatggaatgtgttaaagctgtgacaatgactgtacatatacccaagtgagagaagcagattgaagaggactaatgtatgctagtgttatttccacaaagtagaagaagccaccatatcatttaaggtgcatggatatacggcataagtatacagaaatgcaaagaaatgaaaaaatagtcaattttcattttcatttgatgtaattaattcaggggccaatatggggaagagagctatgagtgaatgccatttgagttatcggtaatgctgtatctcttctcggtggaggggacagatgtatttagaatgcaattctatgaacacgaagcaataattcttccaatgcaaggcagttcacaatcatttttgaattcaagacaatgtgattagtcatgatttaaatcactcctctttgaagcccacccccctccggtcttcaatccagagcaagatgatgagctataaaatctgcaacgacagagaggtgagcatgggagtgcctaaagaaacagagaacgggagcccacacataaccatggcttgtcccagattccactatgacagcaagaaggataccaaataaaaagttatagttcctctattggcctttgttctgcaggggcaaccttgagccctgtcaacctccagacattctcctgtgcattccaacagacagacagacagacagacagacagacagatggttaggaaacatgggtgggattataaatccatttcttgggcagcagtgcattttaaaataagtacaacgtgggaaatgctgctatctgtatttggtccacaatccctatggcaccatcagtgtcaccctgtctgccgtcctttcccacaccacggattatcttaacgtagggatgtaccttaacctagtattcaaattcctgtttttaattaaacaagaaatatatgatcatattctagacataaaatcagccatttaaagcaattatatttataatgggaaaaaccctttgcaaaatagtggtaatttttttcacaagattccccactcctatctcagtctctctgtgtctttctctcccacctttctcctcccccttccttttcccctctcctctcctcccctcttctctcctctcctctcctcccatcgcctcccctccctggaaataaactgctctaatacatatctttccagatttgtttgcttccatacagaaacaggtgtgcttggttattgtgtggctgacagatgaacaaatggttctaatatgcatatagtggtctataatttactcctagaaatgtgtacaaatcatgacaagctcaccctgtcattcgtctagctgatggttatgtgtgacgtgcgtcattggatcagcatggagcaagattgggcagcctctattcccatgctgcttgcattttggtggggatacagacaaatatataaataagtaatacaactttcagtgatcctaagaaatatgaaaattaagtgggggttttgaagggaagtttttatttttgtttttgcttatgagtagtatttcaccatagggactttcctaatttgggggactgactttaaatgaatctacttgcttcccaaaataatatctgcatttcatactgccatccaaacccatcattgaaacatatccacacatcaatcaacacatgaatgaataaaaactgtggcttataagcaaaatagaattctatttagccaaaggggaaattacattgtaatatttacaagaaaacaaatggaacttcaggtcatcttgttaagtgaaataacaagatttggaaagacaagtactgtatgttttctctcatatgtagagtgtgtgtgtgtgtgtgtgtgtgtgtgtgtgtgtgtgtgtgtgtgtgcgtgcgtgaaaatgccataatgaaacccattgctgtgcatgctaacttaaaaaatgcttaaaaggccaggcacagaggttcatgtctttaaatcctagttcccaagaggtaggggcagctggatctctgtgagttcaaaatcagcctgatatagatagtgagattctgttttgtttttttaaaaaaagaagaaaatacacaaacccaaaacgcccttatataagtgaacacatatttcaggaaatattgcttactaagaatgatgcaccaaatttcttattctgttctacttcataaaaaaaatttaaaaaaccacgttaactgtgatgtcattgtccactaaatgactatgacctgcttgatgctgagatttatctggattgttcgtcaatctctgttacaaataatgagctcctatatactcactgggttctgtgactatttctgagagccaagcccctgattgtgtaattcctacacttaaacttctgataaaatatagacagttattctggaaagctaaattccaatcctggatctgccgtcatcacgacgtacaaactctgggcaagtcccaccatctcttcggacctcagtttccccatcagtaaccttatgatctctacattcttggagtcgcaacaacgaaagcagacgccccaccccctgactcagcggacttctcaccaagcccttctcccccttttccgctcttcctcaagcctcggaagcaagcagcgggagaagggaacaggcaggtctaggcaggagggcccaaggctgggaggggccgaggcgagccggccccctagtaggaaatgaggtagatagaagtaacactttaaaagcttgactccctcttcctccaggcattcctggtctcttcccaccctcggctcagctcccggccctcccggacagcttcccttctcgtttctaatctgcagcctgcagagcccgagcctgccccggcccaggtgggacccagaacttctgctccaggatgttgacgaagttgctgtcgctgctgctgctgctgctgcctggctgcgccttttgtaaccaagaagactcagatggtgagttagggacgcggctcctgcctggggggtgttctggagacttggtgtatttggaaactttgacgcgattgtagggcagctaagcccgccgcatggctgtctacagctgctagggtcactctacggtgcacgctgggtcctgggcatcagtttatgttccaaagacaaggcgaagaagttcaggtaactttcaggaggctggtggaagggacctgtagagagagagagtgtgtgaggatgaggagaggagacagagcagagtgtcagtctggcgaagatagaagagaatcagcgaggagttgagatggagagaatgggaaaacatcaggagaacggagacaagtttggggattgagatggagaggtagggaaagaggagaaaggctggaggtgtagctggtgaggtgggacctgggcgggagaagagcccagggccggaaggattccgcggctggaagctcttgaagctaccaaccagcagtattcagaatgcttactgtatttaatacacacatcgactcgtttatgttaccgcattgatctcacggaggagaaagctgggtcacagaacagataaggaatgaatgccgctaaggttactcacaccctaaacacagaaagcaacttctcaaatgcaccaccgggtgggggtggtttacgatgtcacacatactcatccagcgattctcctgataccaatacataccgccaaggcacttttcggggtattgaaggcagggatgaccaaacccagtttaacagctaggaggggtccggtgtgtttgggcactaacattaggaatcccacgaaatctgtgttgatgcaacacactttgctcagacccacttgaaaaggaggggggaaatggcagcatcgggaaaagggctccaaggagaaggccatggagctgggtcttgaaacacagataaagatctgccaggcagaacaagggcaggagagcaaccctgatgagctctgcacacagtggccaaaagtcagcatgaggaactccaagccatttgatgaaactgaacgccgagactggccagaaaatgcagctgtagccagatcacttgctgtggatcccaaactgggacagactccgagatctgtcccgtggatgggtgctttatggggaagcaatctatgactccagacaaagaccggtaggcttctgctaccagtgttcaaatacttggcttgcctcaccatgttagcctcagattcccatacacatggggttaataacagtagctactgcgttaaggcattaggaggaaggcatgcataagttaataatgtgtgcagagcagcgcccagggcgtgacaagcccttaatggatattagctattattatttgggaggggtagggtatgtcactggcgggctttaagggagttgggtcaggtggagatccaaaagggtgaaattgagaaacaagtttctgtggcacccaagcccagatgacagtgtcccagaagaaagggaactggggctggaattgggattttatcataggctggagtgtgataggctggacatgtgagggaggaggcaaagacacagagggatgccttttccaactgcaggccttagtttcctcgtctgtaaagcgaagataataatccccgtcctctcctggcttggttgttgtgagcatcaaataggagggcaggtaggagagtgctttataggattgagaaacgggcggcaggcctctgggtaaggggttattatctctggctgtcagccaccccttccctggctggaggtcctgacgctgcactgactcttcccccaggctcccaaagcctgcatatgctccagatctcctacttcccagaccccgaacacgtgagacatcagggcaatgcctcgatggggaaaatcctgacacatacactggaaggccccgccaacaatgtcaccatcctccagctgcaaccctggcaggatcccgagagctgggagaccacagagaagggcctgcagctctacctggcccaattccacagcttggtgcagctggtgtatcgcgagcgcaagaacagcgtagtctgtgagtggggatgctgggtcggggctggtgggagctctggagattgagagggttggggggcttgtggcggagctagggtgctaagtgcaaggggaaggtgggcgtggtctctgggtggggcttccctgaagagccctggctggcccttggagattgttctgtggggcctggaggtcctaagagtaagaaacctctattagatagatagatagatagatagatagatagatagatagatagatagatagatagacagatgcatgcatacatacatacatgagagagtctatcaggttctcctccagtgacctctcagagcagaccttcttgggggaccctgtccctgatcctctctgacccccaaagtttcagtgactactctgccatctcctttccctcatactcggccctgttctcatccatgttgatggtcccacccacagctccctcacagccccgactcctctcaagtactccattgatttcttgtctgggaagccacccgctcccttccacatcacttctctgctcctttctctcatggtctctctcttcatagctcctgggtcctttttagacaggctccaacagtctagctttccagtcagaaccccttccttcttcctttcatgccccccttgcctccggtgaacatcccccactcctggtaccttctcaagcaagcacagaactgagcctccccccttccccccccccccgcagccctctcccccaaacccgctcccccccctgcgggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggtaccttctcaagcaagctcagaactgagcccccccccttccccccccccccgtagttcctctcacaatcacttgctccctgggctgcgagctcccgtccaaggagcagactgagagcaccgaagcccgcgtcttcttcgatgtggctgtgaatgggagctcctttgtaagtttccagccaaagaccgctctgtgggtgatgcgcacccaggagccctccgaagctgtcaccttcaccctgaagcagcttaacgcctacaatcggactcggtatgaactgcaggaattccttcaggacacctgtgtgcagtatgtggagaaccacatcatcacacaaaacacgaaaggtatgaggaggtttgggccctgcctgtgtgtggggagagggggcagcttccaggcaagtggacagacatgaggtatcccttgtgtaacaaaaggaggggtttggagactgtgcgagggtatatgcatgacttaagtctctgggtgaagtacagatgccttgaggtttgagccaaacttgggactccttgggagtattctcttaaactcactctctgcctgttctgcagggagccaaacaggccgctcttacacttcgcttgtcctgggcatcctggtgggcactttcataattgctggcgtggccgtgggcattttcctgtgcacgggtggacggcgctgctaattactctcgagtcccctcggaaaaagggctggactgaagggggtggtaagggaaggtcacagctcatagaaagccaaacagactcccccagcgggccaccggatctcaggagatttagagcaacaattcactttttctcctgcagctgccaaccagtttgaggaaggggtgtaaagagggtatgtagacaaagcacttgagagcaacaggcatgctttgtttaactggtctgagaagcggtgcttgcttatctgcggaaatcagacgatagacttggggtgtctgtgacctccctgcaaaggcagattcactggaggcaccccaacatctaactaaataaaatgagttgcctgtaaccaagataaacaacatttaatgttatctaggtgcgtacaacttgagaagggatactggtctgaaagaaccagagaaatgtcacaattgtaagatcaagctatatgggagaacaagtaataattaattaaatattaaatatcttatttatgtaaaaggtgtaattatttcctccattttattaaaacttctgaaaaaaaataacctataccctttgttctatttcttcatctgtcgtttgctcggaaaccagtggtgtcctctttctatgaagtagtcaaagatcgccataacctctattgtcatcatatcctccaaaatgtgtgagtcattgactctgggagctggaaactctcttctgagacactgtaattcataaaactattctggaattcttctcaacctctttgcctccattcaccttggaagatgctgtctttcttcttttttttcccatgcactgactttaaatatctatttctcgtggtttctgtggagcaacaagcatgtgtttggagctggatagatgactcagctctttcagaagacctgagttgggttaccagcacccaggatggcaggaggcgcactcacaactgcctgtaacttcagggccagggagtctggtggcttcttctggcctcctagagcactagccacacacacacacacacacacacacacacacagaattttttttttaatttttaagaatttatttatttatttatttatttatttatttgggacagagtttctctgtgtagccccagctgtcctggaacatactctgtagaccaggctggcctcaaacttgcagagatccacctgcctctcccaccccacagagtgctaggattaaaggtgtgtgccactccttaccctcaatgagaagcctatggggagatgggggggtgtgaatgtagggggagaaggaggaggggaggggggaactgggattgctatgttacaaaaagatcaataaaattttttttaaaggtatgaaccatcaccactcggctttaagaacattctaaaatcagatttcagctttacatcttggagtcaggcatttaacttctccaaatctttcttccttaaagggataataaaatacacaaaaggatataacaaaatatctacctcaaacacacattatgggtatcaggtaaactaatgcaagtaagataatacatacatcatgaatacagcaatggttacctctccaaatcccatatttgctctaattttttcccaaaggaccaactccaaggcttcacaaagattaggcaggctcctgacagtgagcagcaattccacccctacactgacttctatgctttgttttagacagggtatcactatgtaggccaggctggccttgaacctgtgatcctcctctctcaacccccccacccgttgtggattataaatatgcctactgctcggtttcctttgaacatgatctctaccttaatatcttgaggatattcaaagtcaacatatgaggaatcaatgttattaccttttccccttttctccctgttatttaatatgtgttaataggtaaaagaaatacattcacatagtatctgtgtagagacctcagtggtaagctctatttacttacttttctttatccccacctataaagtgcaaaatccataggatccattctctctgtactgcccttcctctttctctgtgagaggcacagaggtgtgctgcccaccttcagggagtacagccagcaggggtcctcagccacttcagttcccagtgaccacctcagctacagagaacagtccagcacaagggcatgcctgtcctgtgactgccctcccctgtgactgggcacagcagaggtgtggacacccagctgtgccccattactccagagttccctgccgggttggctgggtctgtgtgggatctacaaagcagtttaacttttcctcaacttgatcctgcttcctcttccagtaaacatcctgcatctccacctctctctcagcatctgcttccagaaaactcaaaactcgacaggcatgtatgtgtgcccctcccctattctgtgtctcctcaccacaccacctgctctgcccaaactgagaaatgtccggtcttttttgactagaccatgcaatagctaaatgctcctcctaagtgctcccttgtctgtaattgtttctttgttcgaattcatcttatacatggcaataaaaaagggggcaaattttgaaaagtctgtgtcatttctgcttttttgttaatttcccattcttcttgaataggacacacacacacactacacacacatgcacatacacacacagatacacacacacacttacacacacatatacagacacgcacatactacacacacatacacacacacatgcacatacacacacactaccgcacatacacacatacacacatacacacagtaaacacacacatacatatacacacactatacacagatataaacactacacacatacacacactacacacacacacagacactacacacacagacacacacactcacacacatatacacagacacacacacactacacacatacatacacatacacatacacatacacacacatgtgtacacacacatacacacacactgcccaagtgctcactactgtctaccaggcattggtgaggatggtccagttgtggcatccttaactagaccgctcttttgtgctgtgctagtagtctcttgttctgttttctgagcttgattcactatcatcattatcagtttatttattcatccaataaatgtccatacacagatttgatgctatgtgcattggaagaaacaaagtgattaaggcatggtccttctcaaggaagaaatgacataggattaagtcccacacaaggcagatgttctcagggaacgtaggttagaggaagccacgtacaaatgcaaatgctattgttatttacagttttagctatcgcttatacattgttcataatttttatagttctttaatatgatttgtcactttaaattcagtgaagtctcctaagatacgaattcttatcgtatcttaggtaaagggctcaacaagtaaagctgcttgttaaaatccgttttgaaacccacttagtaggaggaaggagagaacctactctaccaagttgtcctttggctttctgcacatgctccatggcccacccacactctcacacatacattttccatacacaataataatgaattttttaaatttcaagaaaaatgcatagtatccttcttaggaaacatgctaccaacaataaatagagtggcagaacagggtttaaaaccatgcccttgtgttctgacatttgtgctttctttcatctagaactgaggaaatcagagcaatttctagggaagtgcatacatatccacaacacacacacacacacacacacacacacacacacacacacacacacacatagacagagagaatttaaaataaatccttaaaaagaagagtggacaaagggctttgctggaaatgaacacgctcacctttaaaaggtatatggccaggcaacatagtaagatcctgtctcagaaaaaaacttattatataacttattatataactcatcaacttcactctttgtatttaccccgaagaattgaaaaaatgtgtctacatgaataattataaacaaatatcatagcagcattgttttatctgtaagataaaaacaatgcagactactgctgctttatcttgctatgggatgtgccaagaatcataggttgtagatgtaataggattattttgagtgtgtcttgattcattttctgatgctataacaaaaatctgaggctgggtaatttcgaaggaaaggaggtttacttagttcacagttctgggggttagaagtctcaactccatgtgtgcattctcaggaaaggaaggcccttctgactgtgtcatgtcatgatagatggcattacatggcatgagtgtgtaccaaagagatctcccagagaaagagacagagagagatgggaaaggactcactttcataactgctgctctcacaggaactaaaccactcctgtacagtctaacccactccatgagactggcatgaatcccttcccattgacaccatagctgggtcatctcccaccacagccccacctattaaaggctctttgaatatcatggaggtagaaactaagtttaacatgagtatcttcaaatgatttcgaaagggttctcagagcttttgtgtccacatccagaaacaggaggtaaaggatcaggaccctggatgagtcaccttggtccctcacttcctcaagagaagggtgactggaaattcagctgacacccgagcagctttcatggctgtgtgtccctggtgcagtcactactgctctgtgggaagcagctgtgatttcaaagatataggccagttctgacagtcagggttctagctcctaactccaggcagctgacctctgggcagattcttaagggtccttgatgttcctccatcttcagagaatgacctcaggatgtttgccttaagtctgagccttggcagccaaactactgaaagcccaataggagtttacatgagaaataaacaaatctggaacatatttaaacaagtgactcccaagagcattctaaaacccttcttctgggtggcctgtagtccccatttaacatcaaacttgagtgtcttcattgtttgcattctgccaggtagcctacctctaggcatctgtagccccttctttttttctttatacttaaaaaaaaaaaaaaaagacatgctgctgatggtgatggcacacacctttaatcccagcactggggagacagaggcagggggatctctgtgagttaaaggccagcctggtctacagagctagttccaggacagccagggctgttacacaaagaaaccctgtcttgaaaaaaacaacaacaaaaaaagacatgtgtcttagttagggtttcaattgctgtgaagagacaccatgaccacctcaactcttataaaagaaaaacatttaattggggtggcttacagtttcagaggtttagtccattgtcaccatgctacaacatggtggcatgcaggcagacatggtgctggagaaggagccgagagtcctacatcttgattcacaggcaacaggaagtggtctggggcactgggtgtggcttgaacatatgagacctcaaagcctgcctcttaggtggtatactttctctaacaaagccacacctactccaacaaagccacacttcccaatagtgccattccctatgagcttatggaggccaattacattcaaactgccacaacagtgtttcactatgtagttctgactggcctgtcacttgctttgtagactatgctgacctcaaactcagagatccatttgcctttggatcctgagtgctgggattaaaggtgtgccaccacaaccaacaatagcccatgtttccagttcattgcactattggtgggatctattttatgctaaacatcctggtaactgctagtggggagaggagaaatgggtaagacggagtctctgtggagccactcctaatctagagggagaagtacacaaaacaacaacaaagatgcaaaatgagtttagctgccttcccaggagaaagaatcccaggaaagcacacaggccaaaggcctcatcagggcttgaagaaaaacaatttccacagggaaagaaggggaagccattgctctgctcttaggccaagatctctgttcatctctgtctagcacaagaaaggagttcagaacacatttgtcaatgaatgaataatgagtagattctgaactgatataacagcacccaggaagagagtacaagagggttagggaaatggctcggtgagtatacacctgttatgcaagtgtaagggcctgagttcgtatcctcaggacccacattaaagctaggcataatagcatgcgtctggaattccagtgcccctacagggagatggggtgtgtgcagagaaaggagaatctaaagaaacatgtgggccagctagcctggtgtacacggcagcaaaagtaacaacaacaaaacaaacaaacaaacaaaaaccagacagtgtctcacatatggtggaagacaagaataccagggatagttctctgacatccactgtggcagcacagcacacacaccaatattcacagatatacacacatcatacacataggaggtgggggaggaggagggagaggaaggaggggaggagggggaggaggaaggattgttctcgatacagtggtaaggtctagtgtggcttcattgactacagattgtgcttcagagtggagtgggaagtaaaatgagatttaagaatgctgtggggctttaatcccagcactcgggaggcagaggcaggcggatctctgtgagttnnnnnnnnnnnnnnnnnnnnnnnnnnnnnnnnnnnnnnnnnnnnnnnngggaaaaaaaaaaaaaaaaaaaaaaaaaaaagaaagaatgctgtggggcttcactaaatcccacaggtgatagttaatgttaatgacttcttcctctagacaacaatatctttattcatctttgtagccatagtgcctggagacagccagagatttagacaataaacgacagataagcaaatgaggtgaaaacttttgagaaagaaattattcctctcgatcaatattattcctcccttattttattttatttgagagagcatctcactatgaatcccttgctgtactgaaaattgctatgtagcccaggctggcctcaaactcatagagatccacctgtctctgcctcctgagtgctgggattcagggtgtgcaccaccatacccagctaattcctcacttgtatatataattttatagtcacagaaatacttttctttcagtatctcatttaacattttattgatatacccaacaagtttgtgaggactgaaggacaggtcttatcctcatttcctgaagtcactgtcaggttctcatagccagtgtcaaggatcaaaactccgtttcctttagtctcttcttgcatggctggcacgctgttgtgcatctctgtgccgaagccaggcctccctggagtagcttcactctcctctcccctcgctgtactcaggatttctacatgtcccccaaatagatgaaatttatggatgggggccattttacctcacgggaaacctgggaagagggtcctcacatcccatggtgtggcacaaattcttagcaaatgtctaaacacttttggattttgttttgttttgttttgacaaggtctcactttgtaacctgggctagcctggaacttgatatgtagacctggctggactcacacttgaactcacaaagattcacctgcctctgcctcccgagtgctgggattaaaggcgtgcgccaccaacgcccggccctgtcactgctttgcaaccttttcccagaaatacaaagccctttctttatttcctcatctctcatgtttcaatatgtatgttcctctctgaaaaacaaaagttctacattttttttgtttcttaatttcctaaaatctgcctcttagtgtcttattttatgcacttgcaagtgagtcagtttgaggatttcacacagcctgtagcactccacagaccaggcagtggggcttgggaagaaaaaaattaaaagttaatctaatgtcattttctgacagagcaattcagtaatgcagctggctgcttcacatgattaaatgtaggcaaacacttcaagttctgacctctggaaatgcatccccacatattcatagagacaatcatctggcttacaaatctgctgcagacttaacatctttcagcccttcaagggctcttcactggctgtggcatttcagtaacctccaaaattcatcgctttattattagaaactatttacggaagccaagtaggtgatacacacctttaatcccagcactcacgaagaaggcaaaggcttgaagatttctgtgagttcaaggccagcttggtttacatagcaacttccataccagcagggctatacaataagaccctgtctcaaaaaaaggaaaaaaaaggaaatatccttttcatttcaagcatgtgataatttacttggtatcttttgattctgaaggaaaaaaagataagtgtgtctttttcaaaggcatatttttctctattaatcatcaatattttttttttgagacagggtttctctgtgtaagctttggagccctggaacttactctgtagaacaggctggccttgaactcacagagatcagcctgtccctgcctcctgagtgctgggattaaatgggtataccaccacccagctgttcttttaaagaacaaaaatgaaaaatcaaggagggaattaaaaaatccctagagtcaaacgaaaatgaaagaaccgcttagcagaacctttgggtgcagctaaggtggctctaagaggagcatccaaagctgagagttactgctcgcatcaaaccactgaagagctctcaagggaattatgtgatgatcctaaaggtctcggaaaaatgagaacaagtcaaaaccaagagcagtagatggcaagcaataataaagattatggggaaattattaaataaaagaacaatcatagaattaatcaagtaaagaaaaatgaaatcaggacatttgcagggaaatgcaaatcattatgttaagtgaaacaaatcagattcaaaaatacaaacgcttcctggttctcccatatgcagaacctagatttgtgtgtacgagcatcagtgtgtgcgtgtgtgtgtgtgtgtgtgtgtgtgtgtgtgtgtgtgtgtgtagaactaaaaaggggacaatgagcgaatggggaggctgaagaaatggctcagtggttaagagcatgtgttctttctggcagacagcctgggttggttcccagcacacacaccttgtctgacaactgtctagaggacagttctaggggatcacagccctcttctggcctccactggctctgcacacacacactgtacacaatgtacattcaggcaaaacacccatgcacataaaataaagaaatcaatgtttctaaaagagggaggggaatgagaaggtaatgggatacatgtgtcttggaagcagaagggaaggacaactaggaggaggaaggagagcagcaagagggacaagggaggcactggggaaggggagagcatcagaaccaagtataatgacacagagtatggaaaatgtcatagtcaggcccatcgctttgtgtgccaactttaaaagtttttttttttttttttttttttttttttttttttttttttgggcccattatgtcaagtgaaagaagccaagtccccaagttccacattgcatcattccatgacatgctggggaaagtagaagctgggaaggccagggtgtggccaaggcagagggaagcttgggctcaaatgctaggggatgttttggagagtgatttttttctacatttttactgtggtggccacatggtcctaacacttttgtcagtattgcactgtaatccccaaacagagacttccacgtaatataaattaacaagctgtcccctcgaatcataagaaagcaacctctcccgggtgctgcgggtggagaattattttttagtataattttaggactgccttcatcactgttagctagttctgtcctcgcctcccacaggacctgaaatctcatccgttggcatttttccgtctgctctggttaccccttctctctggggacggtccagctcttgctccattgggaatgatgggaaaactcaggaagtcaggctaactggtaatcgcagggtggtggtgcgcagacctctgaggggccaagacccagcacaggggacgtgtgatgggaagaaagggaaaggcagacctacagagtaaagcacaggccaggaaaggccacgggaggctgtcacagaagtgggcaatgttcaacagggagggactgcgacaaaaacacactggagtgacctcacagcttggctcctggctggctctgggtgtaggccactctccttccgagcttcattttccgatcttgctcatctgtccagtcctgctcatagccctctagctcacatcctctccgaactgacgctgctgacaccgtctccttctcacgcagctcggcatccactttatagctgcgtaactcgtctgatccaagggaaggagaattatccttcctttccagaggagtgaagaggcccaggaagcttaaatgatttgtctaaagtcaccctttgaaaactgtggcccagacaccttccattgcttatgctatgctgccccctactggaatgatcgcagatacaccaaactacaaacaacacacttctacagtgggcttctatttattcgcgtaccaagcattcattgattaacctactatgtgctagaaacaattcagaagtgggctgcgcccatggaaaatatggacccagtcatttgactgaccagttacagttagatgagctctgtgaaatacaaagtatagggcatagaatagggtgtgtagccttacagtaaagaaattcagggaatcgtggatgaagtagaatccataggaatacattattggctggcaactgggagaggggactaaggagttatcaagggtgcttcacagggctcagggatgaacagggaaggtgggatactgccactaagttgagagtacttaaaaggagatgagacagctgggtggtggtggcggcggcggcggcggcggcgcacgcctttaatcccagcccttgggaggcagaggcaggcagatctctgtgagttcaaggccagcctggtctgcagagctagttccagggcagccagggccacacaagaaaccctgtcttgttgggggagggaggaaaggagatgatacttacaaagaacagtagtttggttttgtggcagtttggaaataccaatgaggaaaggaaagcatagcagtgaatgagaatctgggctgagtgatcactgctgtgaactgaggtctacactcaaaccagtgggaacaaaacttgggtgctgttgggtgtgcagagagaatgcagatagtatttgaaactgtggcagtggatgaacgcacagaataggaagggggcttctttttatttcttttttttattagtccaaattaggaacaagcttgcttcacatgtcaatcccttctccctcttcctcccctcccccaaccctcctccaaccccccacctgcctcccccccagcctcatccaccgtccactccccaggcagggtagggcccttgacggtggctccccaaagtccaccacatgatcctggaccaggcctaggccctcccccatgtgtccaggccaagagtgcatcccttcacgtgggatgggctcttaaagttccttcttacaccagggaaaaatactaatccactaccaggggccccctggagtgtggaggccacctaattgacatccatgttcaggggtctggatcagtcctgtgctatcctcccagacagcagtctggggtccatgtgctctcccttgttcaggccagctgtttctgtgggtttcaccagcctggtaccgacccctttaatcttcatttctcccactctgcatctaggttccagagttcagttcagtgtgtatctgtgggtgtctgcctctgcttccatcagccactggatgagggctctaggatggcataaaaagtagtcatcagtctcattataggggaagggcatttaggttatcctctccatcattgcctggattgtcagttcctgtcatccttgtaaacaatctggaaatcttggaagggggcttctaaagcaggccaagaaacctctgcatttacattgaagagacagaaccagtggtggagagccaagggaggtcccagagggataaggtggagcatgggtcaacagcttaataaaacagttggggctggcaggatggctcaccagctgaaggtgcttgctgcaaaacctgaggacctgaggttcaaccacgtggttgaaggagagaactgacttccacgggtgtcctctgatctccaactcatgccatggtatgttcccatgcatgattaaataattagatgttttgaagtgtagaagagccaacttgggtgaagaagttcgagggcagcaagtcacaatggagttctttcttcacaggcatatagtacgccctgtggagaaagatgatgcttttgaagtggcacttaagggtctggccagcatcatgagcttgtgggccctgcgctcgcctgggccccctgctgtttaaatggtctgtttcgatcatcttgaaattcttagcatttgaactcattttgcagccaacaatgaccacccttttgaccttcctgcctccccctcccagatgctgggactacatcacaggggtatgctttgttttgctttgcttttttagtttttagctttttcaagacagggtttctctgtgtaaccgccatggctgtcctgaaacttgcattgtttgctttgtagaccaggctgccctcaaactcacggagatccacctgcctctgcctctgcctctcaagtgctgggattaaaggtgtgtgctgccttggtcaggggtatgttttaacaagtggctctgagttctccttttgcattggggctaataaatcatgaagtaggccctgaaaagaggcaaatgcaaggcagagacccaggcatgatggcacttgtctgtaatggagaattgcaagtttgagattctgtctcaaaaacaaaacatgttctatttgtatttttttcattaattgagaatatatgtctaagtgagctagccaatgactagcctgggataattgagaccctatttcaaaaagaaggaagggagggaggaaggaattcatgaactaaacacacaacggttggcagtggagctggagagacggctcagtggttaagagcactggcagcttttccagacgactagacttcgagtcccagtacctacctggtggctcacagccatctttcaccctacttccagaggatttgatgccttcttttggccccctcagggactgcacacgtgtggtgcatattcataaaatggaggcacataaaataaaaacaaatcgaggttgacagtgaaagttctccctgccaccctgtcctctggctgtatgggtccctgactgaagccattgcagtcacctttccatccaggagcacctttcgatgttttctgtactgacaggcacagagactactgtgtcttcccaatggtgcacactgaggtgtgctacacctaggattctgcacttgacttttcttccactcagtattacacttcaggagccataagtagcagttgtggctatactgcctgcacccaggaggccgaggcaggaggacaaaacattctagtccaccctgagcagctgttagagtttgctttctattcctgtgacagaataccatgacttaaagcaacttgggaagaaggaaagagtttatttggcttacaattctgattaccatcaatcatgaaggggaggtcagggcaggaactcaaggcaggaacctggaggcaggaactgataaggaggtcacggagaggtgctgctgactggctcgcccctcacggcttgctcagtcttgctttactgtaccacccaggcccaccagcccagaggtggtactgcccccagccctcccacttcagtcatgaaaatgccctacaggccaatctgatggagatgttttctctcacccaggagttagccaggtcctgtcttgcttagcttctaagatcacacaaccgttcaaggtggtacgattgtagactggagatgtttcctcaacttaggtttctatttcccagagaacttcagcttgtgtccagttgacaaaaactgaccaataggctgcatagtaagaccttgcttaaaaaatactaatgctacattaaaaaaataatttcctaattaacaaagaactttctcaaaaaaaaaccaaaacaaaacaaaaagcaacaaaacaaaacaaaaaaacgggcgcacagtgcccactgcatgtgccctgccttgtttgtggttttcaggggaaaacatcagcaggaattacctccaaaccagttggggctagatctgcaaacagaggtggcaggctgaagtggggcgagggggctcttctagacccccccatgcctttgtcctccatggtttgtcaattaaaatttcagtcattcattgctcaaaacttttagacacatggtcatgattgacgatgtgtattacatggcaatttgtttttaagatattatgtttgtacatcctcatctcaaaggccacctccttttggcacgtttctttgaaactcctagatttcctcagccagaataacgtcagcggccccggatgttctggagggcgatgtcctgagttgtgattatttgtcctgtcttaagggtgcttgttctcagccctttcatctgaagatggtcccactcgccctgcttccttccaatgagcaccagtgtacctgccttaggggtcacagcctgtgccccatcaagctagatttggctacctgtcctcaataagccaatttaaaaagccaaattaatagtggaaagcagaaaaaagtagcactggaacagtgttcaacacagttaccttgggaagactcgagtggctgcaagggctctatgcccctcttcacagtgaccacattcagtctctctctctctctctctctctctctctctctctctctctctctcctcttccccctccctctccagaactagactagcgtccgactaacctctgtttccttccagattcctagtaagaacttctcttttgtggctgcagagacggctcagcagttaggagcactggctgctctggcagaggatccgggttcagttcccagcacccacatcaggtggctcacaaccatctgcaactccagttccagagacactaatgacctcctctggcctccatgggcattgggaatgtacatggtgcatatacatacatgtgggcaaaacactcatacatataaaataaaatcaataaaccttttacaataaaatacctcaattatttctcttgccacttcccttccttccaccctcctccctcgtccgtctctgttttctcattttggctgcaccttcttaatatctttagctggctcctctctgttttcttaatttttaataacagttgttttagaactcattcactagaaactttcccctctctgaatgtgcttattccctaaaacatttcttctagccccttggcttcaaatatttttattttggacgctccaagtccacactccactcgacttctccctgaactgatacctgtgtagaaggctgttgccacatccattcgataatgtaatagctgtctccctctccacacaccccagacagggctcttgatatttccattcaagctgttcaagaaatcttctttgtatcaaataatggcagctgcattccagttgcttgggtcagttctctgtaatgtgactcttctttcctacttcctatccaaagctttgtcaactccactttcaaaatccttaaagaacccggctacatctcactgtgtccacaaggatcctgatccaagaccttgacatcttgtgcctgccctacagcgatagccagctccctgccttcctgcttctggcttcccagctattctctgcccagtaaaaccagtggttctgttgagacctaagcagtaagttgtctcttcagttctcagaaactcccaggagagcagtcctaggagccccacccttccacccccctacctctggcctctacattgtcccttaaacttgcctggcagtttctcaccttagaacatttacacttactgtcccctcttccagaatcatttctccatgtctcatcctttgttctttcagaactacacacacacacacacacacacacacacacacacacacacgcatgcacgtgcatatgcgcacacaaaaccttcattgtttcttacaaaagtccctctagacaccctaccacaattccacaaaaggcacggcacacacccctctaatttcaggtcctaaccccctgtttttctcaacaattactgctatatacttactttaatgatttttttgttgttgtttgtcacccatattctaagttctatgaaaactgaaggttttttgtttgttttttatttttattacatctttagggggagcttgcatgtgtcacaatatgtgtgtaaaaatcagaggacaatttataggactcagttctctcctttcatcatgtaggtcccaggaattgaactcgggctcctcaggcttggcagcagggacttgtgcccactgagcctagttgcccccagagttttatctgatttgtttactgctgtaaagcaagagcattcaatgcaaagttggcatttaaaaattacttagtgaactaagaaaatatttttcaacttatgtcttctatttagaactctttggtgattcccaaagcagagttcttaaaccctttggtctcaagaaccctttatactatcaaaaagcattaaggacactaannnnnnnnnnggaattaaaagtgagaaatttaaaaatgaacatatcgatccatttaggatgataatatggggctctggactagctcagcagtacagaacttacctagcctgtgaggccctggacctagtctccagcaccacaaaaatcagcaaataaataggcaatcaaataccacaagtctgtaaatacaaataaactctataataatttcctaaataaaacatagtgagaggactggcattatttacatttttaaaaaatctgttgaaaaatttggcttagtaggaattaactgtattaccatgcctactgctgaattgaacctatgacaataagcctggaagcttctagaaaagtacacagcactttcatgagagagtgagaatctgaacattcacatacaactgcgcctttgcgccaccacttccctccactccacatggcaagttcctgctggtcactcacggcctgactcacctcctgccacctctagacaattcatttcttccttctcctcccataatacattgttctcttctctctcaagaatatattgtgttagcctcttgttacctagattagtgtctgtttccacagttaactttcttcctccagacagctagctacatacccaaataatctttatttttcccagcccctcttgcagtgtctgggagtcaaacactgtgtaataaatgcgtgttgaatggagagatgacacaggagagagggagaagggcggtctctccttcctgtagtaacagaaaacagtatttctgcataagattacagatttcagagtggcaaatatgatgtgatcaagtatgttacagacaggtgaacacatagaaaaatctcataataaaatcatattttgtacaacaattacatactaagttgttttttctaaaggttaagttaggcatcggggcacacacttttaatctcagcacttgggaggcagaggcaagcagatctctgtgagttcaagaccagcctgttctatctacatagtgagttccagtttcaggtcagccagaaatacatagagagaccagttcttaaaaaaaaaaaaattatcagtccaggaatatggctgagttagtaggacgcttgcctaaggagcacaaagccctgggttccatgctggcactatttaaccctgatctggtggtgcacacctgtaatcctagtactccaacaaatgaagggcatcttaactgcgcactgaaattgaggccagtctgggctgcatgtgaccctggctcaaagaaaaaattaacaatttcaaagttttcctaacacttatttagtgggcacattgttcacattgttcacaaagtgaatctgaaccattatgtggtttttcatatttaaagaataggtggcaggtggcgtgggggacagggaggattgtgacacacatgggacaccagtctcatgttacaaaggaggaacacaaggctcaggagatgaagtgacttgccttaaggcacactgaaatcagcaacctggccttgaatccaggtgtcagacttgaaatgaaatacgttttctagttatcccatacccatcttggttgtgagaggctgagaagtcaagcagtccaatgaatacaatgaagttttctaagacacctctggcttctgtacagacttctaccttgctcttgcttctaagaccatcttaggaactcatgatatatatccatttgctctttttccccctaatttaagacttgttctattttaaataatttatttattcctatgtgtatgtgcacaagactacaggtaacctcggaagccagaggctcccctcaccccaccccacccccaagctgaaattataggcagttgtgagccacccaacgtgaatgctggaaaccaaaccctggtcccctgtaggaacagcacaggtgcttttagccactgagtcaattctccagcctgtgtccctgtattctgtttgtttgtttgtttgtttttcgagacagggtttctctgtgtggctttggagcctatcctggcactcgctctggagactaggctggcctcgaactcacagcgatctgcctgcctctgccgcatgcgccacggacgcccggcatccctgtattcttattggcctctcgtccatgtaccactcactgccatccacgtctcccacccgtccatcatggtagagcattctgcttgggatcatcagtagcagctgatgggcggttgaccttaaacaaaggaagtcacaccctttccttccctgggtgttttattttctcctgcaacacagcccgctcaaaccttcccaatatgagcaattcattatcttccttcagtgtttctgcaatgctttggtttcatctgtgccataacttacataaccttgcttttttctctatctcctccctagattgtaagttgctcggtgctatttgccagtcttcaacctccttgcactcctgaaactgacaactcctcctctcttggaaaccttcctccctctcccatcttggagatcctgatgtttagctctttgggagggcatgggtgtacatgggtgtacgtgtgtggggaggctgcacttgctcatacaggcaccttggctgtcagaggttggcatcaagatatctccctcaatcacatctgtattttatttatttacttattttgagacaggtccctcaccattttagcgagacttgctggccaatgggaccctgctctctaccttttcctacacccccacggtcccggtgctgaggttacagacacacactgactttatataggggtgcgacggatccagactcaggtctcatgcttgtatggcaaaacgctttgtccaccaagccttctccctagccccagccctatttgtttcagtctttttatcgctctggactcttcagtgggatcttctttgggatggatcctgatagggccttgggcctttgctcttttctgctccccttttcagcttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatcctcctcctcctcctcctcctcctcttcctcctcctccttgggtgcccttcgccatgccctacccctgccatcctagcaaacaaaatgtgttttgaggacagattgctccagcagcactctatgaatcatgtatgtttggcaaacgtattcagagcctcctctttatcttaaattggtttacaataacaacctgtttcacagggcttgtctatgaggactgggggagatatagttaagtgaggtgcttagcccggtgcctggtatgtagtaggcattcattaaacagtaactgttgttgtgctctgagtgtccttttatggggactattgaagtcctctccagatcttcttgtcattctttaccttgggaggggactaacatgaaacacttattataaatgccaaggagcaacagcagttaagtcatcattttataagtgagatgagccagtgcttggacataggtcagactctcaacactgctgctccataccgccaaaccaccaaaccaccataacttcccactatgctgctcaagaaaacccctagccaccatcttcatatgggaagagcccagactgacagtcccaaaactcatgccttcaccatttctcttacttcccagcagttctctgtagaaaccttccagggacccaggtactctacagaaaccaccccaaccccattctgtacaccccccactcctcccttgtctaattcctgcctttccttcagggccttgctcaaattccacctcctctcacacacctttctcgggcctccttgagcccggacctctggaatcttttctgatatttggtaggtagtatcctgtttttctcagcccttacattttcttactaggtgcaaccctctacagtgtacacatcggttcatgggcccccttttttgctttcgtagccccagtagcccagggcgctgtgtgtagaaggtgttccatcaatgtgggacaattgggggtaaaggagcgagcttcccagggctgtcccccaaccccttttaagcactgcccaggtctgttcttcttgcttcttagcaacccccccccaggcaagaccctgagaccccccttctctgatgccaagcacttctttagctcattctcttccaacccaaattgtctccctagccccctcttctccagtgtcacccaccccacccccagcctctctcctccagtgctagcctaaggctgcagaccccaggcccaacagggccaccccggggccagcattatttatctggcctcttctgcctcccccggggttgccctctttgcacccggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggagggtcgggatggccgcggtggcggcgggtagtgtggcctgcaaggctgtgtgtgagggaaaccgtacgacgcctcggagtaaatagtaagcgcagccagtgtgttgtgggctggagaagaagccgaggatgttggagctggaaaagggggagggaggagggcgagcaccgaccggatcgctgtcttggtggctgaagggccgtcgggatagactcgatagatcggcatggtctcaccgggcagaaccgaggccagccgacagtggggggtggggggtagcaagaaggcgcatttcggcccaatgcaggaagtttgtaacaattggaggtgctcagccagcccaggaggcggtgagctgctcatcactggcatgggaaatcggagctccaagaggggattggatggatgcatgcataacgcctgtatggatacaagcataataatagtcgtgccctatgggccaggcttggcgctacatttgataggaattagctcatttaatcccagtatgtgtttcgtgagctagctggagcacctgtccccattttacagatgaggaaagagaccctgagagcttaagtaatttgtccaaggtcacagagctagtgagttgactctagtctcttcatgtttaaaccaggacattatatcacacggtgtcggagtcagttggactaatttctctgctctctcccaacctagaagcccgaaattctaataaataatgttgagatggtgttaatgttgctggaggaaattagtgattgcttgaattatcctgagaggagtatgtttgttaagcatgcattctgttcagaagaatttgccagaacagtagttttttaactgggcaagagactcaagggatcataaattctctgaaattttttgctaatttgaatttacatgtgaaaatgtatggctttcaaggagaaaaatccctagatttttttccagactctccaaagaagatatgttgaaaaaaaattagaatgtgtgaaagaatcctttgtcccagccaatagttggcctcctaagggtttatcattgttacctgactttctgtgaaaactttctctagtttgtttgtgggtttagctctatcacacatcaaagtgatgtgattcatgggttttcaccgtagcagaagtagggttcttccagactgcctgaatgtgtgcagggtgagtgggaagggccctaccctggagatcaaggtgtgtgggctctcagctgaccttggcccctggaggcttgtgactttaattcatctttttccatggctctcatcatctgagagatgaagctgaatgagatcaagttggagaccttttatgctggtctctctcgaattaagagacgacagtttgcttagatatgtcagggtttgaagagaaggttacgcttgctcagtgcttattcttaccagccttacaggcgtcaattattccgctctcaacgcccttctccattttaaacttaagctctcccatcatgacgggccacctcccatcacatgtttcctaggttatttttgttgttctctgtggatatctggaggagttcattttcaacctgaccactgtctccagatgtggtgtccttttaaaaagaaaggataatttctcctttggcttgccggtcctgtcccattacatccttttgttagatgtcctgatctacgcctatcagaccacagcctttgggaaatacccacaagagcaccctgctccctttcatgagctaaaactaattgcctggagcacaacaccttgctgtggattgtttttatgggactgactggcatggatctctccacactgatgtccccacctgtccccacctcccaccacttccacccttggcacggcatttccctgtctggaagggtttaacgtgtgctgcagtcctggaattttctttgctctactttttctggatcacttataaaaaattaagtcagacaggtaccagtgtggtctcttggggccccttgtgctccttatccccttccattcagaggagtgactggctgtttccatctggtctttcctatccctaagttcattctcaggccttaatgaagacatggcccctccagcccatttaaaatatctgccaaaactttgagaaattattgagataatttgcacctaattactccgtcactgaatattagtgggtgacacgactgaaactttatagaaatatcattgcttttcagcccacagataacattgctcactcctctgtctgtcttaaggccgctggagtcccaccactccctgcctcccgattagtaagccacctttcccactgttcatagataatgcatcctgactccagataagctcacccctcatttatcctaagacaggctgcctgggttccctggacatggtcacgtgttatacctccacccatttcatcagatctttccttaaggttctggctcacacctgcctttctaggaaaccccttccttcccccagaatcatttattcctctcaggggaacatttagtggcatgcccagtcagtgtgtcatctaattttttaaaaacacttgcacattgtttgggaaggaaaaggttgtggatcttggtcaagtttcttcccaagcaaaacttaacacaatccccaatcttaaatacttaccattaagcattgtatccttatgtccaagggttacactcacctgaaataggcacccatagacacataggtttcaaggtcccttctaaaaacctttttcagggaataaagagatgggttgctgtgcaagcatgagacccgagttcaatccccagcacccatgtaaaaagcctgagggagaacttatttgttgtcccaattctggagaggaggaaacagggtccctggggttcaatagccatccagcttattctaattggtgagcctcaggttccagtgagagaccctgtctcaaaggaaaaaaaaaagcaaacaaaaagaaaacaaagacaagatggatggctcatgaggaacaacacgagattcatctatggcttccacatgcacacctaacacacacacacacagaggtaccacacacacgctcacgtggacatctaacacaccacacacacacacacacacacacacacacacacacacacacacacacacacatgcatacacacaaataaagaacttcttagaggatgcattgcttgggcttccttccctggaactgcagtctactcccctgttgtaagcagtaccatcacaattcacctttgacatctgtcttacctccataggtgggatgtcatccaataatggtgacctacagggaagaaggactgagaacggtggtcatcactgtagcgatcaccaagtaaacacactgaagctcttaacggttatttcttcaattgtcttaaatcaggtgtccaaggacacaaaccttgattgccaatgattcagaccagagctggtccccggcctcctggcttctaaattgaaagtgtttttctttactgcctttggcttttgatttcatatctctggtctttcattaccaagccctccccaaaaagaattgattcagtctgtttttgcttttgctttctcaagtgcttcttttgtacttgtatgtggggtgaggaggggcactaccaaagctctaattgactccttgcctttggtttatttaaagcacccctttctcttggtgctagcaggggagaatccccatctttggttttgtccttccaagtataatttggttttgaggaaaatcagagtagatagaaatgagataagccagtgagcccaggccgcatgactctgagattcaggctataatggagtcctgcccatgagactggttttgagtggcggtgctctgagcagatggagagcactctctggtttgcacctgcagtccaggaagtgaagaaccctggatgagtcggaggctgagatagccctattaggaagcactgacaaattcccaagtccctgatggatgctttcagtactgttgtagtctcccgtacatcccactcttgtctggggaaaacaggccattaaaagttctctttgagacacaagttaaactcgtcctgcatcttcttatgttactgtgggttttcctggtgtcctaccaccctccgggtgtgtaaggagcttcgaactttccagaccttgtcacttatgtgtggtcctagcaacagcctcatgaaggaaccaaggaaactgtgctcacttcatggatgagtaaacagcggctcagagagatgacagggcttcctgtcagctcctccagggacccacccacagctaataaacaataaggtggagaccagagctggattctctgtccttgtgctcagcgatttccccctgcacaaaactgtcctgatgtggattactggggccgccattttccactttcaagtatggcccacgccagtctttgaaaggtgatagtttgaaaatcagtaaattatactgctggaagtgaaccctaattgtatcaagagagttgtgttaggaattgcttagccttgcggataatatggaattgtgtggacttccaatgaggaggaagccattatcccctcagtgcccacccagcactgtctgacacctactgtgagaaatgcttttactcctcttgtctgtgtcccctaaccatattctttggacagtgcttggtacccaagtattcagcagttctcttgaagaatacactggactcaaatatatatatatatatatatatatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggccttactgtggagcccaaactggccttgaactttcagtgatcagcccacctcagcctccccagtgctgggattacactcagctttgtccaagaggcaaaaacatcaggggtaggcaagtcctaaggagggagggcctgagatgcctcagctgagcttggggcagtcagaggatgcttcagggggaaatggcaactgagacaaatctcagacagaggggaagagtggagaatggtgggtcagcaatccaggcagggaaaacagggaaccatggcttcccctgagttcctggcatgtttaggaaacactggataattggatatatctggggcatcgagttactcgcttgtttccagtaagagtgtggaagaagagtctggaaagggaagctgtgagcagtctgtaagattggctttggcccagaggctaaggggcctcgttaaaggcatatgagtggagaagtggcctgtttggaggttgtgaggaggctgaggagccaggattcactcccccctgcactgccctgagtgctgattgtagctccaggtgtttcagacttaacaggacttaggcctggctgcctgtggtagcaaatggtatatggataaagctatgaactctggccctgcccccacccttactgaaaggttttgcttttttcatttgtttattttgcaatgctagagcttgaacccaaggcctcatgcttggtgtgtattatcgatgctccctgagctacacctcagccctgcagagaggtttcagcgacaatcatttggattttctgcactccaggattcatttcactcaagttctgataagtttttttttaatctcaaacattccatttcttttttttaacagttccaaagattttatttattttatttgaattacaaacaagattgaattacatgacaatcacagttcccttccccctcccttcctcccctaccaccccctgcaactaaaactctaccaatcacatacctttcttctaatcttcacctgactcaacctttctgctccctcatgacctctgcatccttccttttcttcccttctcattctcgtagctctctcccccctcttcccatgttctcaatttgctcaggggatggtgaccctttccccctctccaggggtcaaagtttgtctcctttagggtcctccttttttactagcttctctggcagtgtggattgtaggctggtaatcccttactctatgtctaaaatccacatatgagtgagtacatatcatgtttgcctttttgtgattgggttacctcgctcagaatggtttcttccattttcctgcaaatttcaagattccattgttttttctgctgagtagtactccattgtataaatttaccacattttctctatccattccttggttgaggggcatctaggctgcttccaggttctggctattacaaatagtgctgctatgaacatcgttgaacagatttccttgttgtatgaatgtgcttcttttgggtatatgcctaagagtggaactgctggatcttgtggtagactgattcccattttcttgaggagtcaccatactgatttccaaagtggctgtacaagtttgcactcccaccagcagtggagaagtgttcccctttctccacatcctctccagcataaactgtcattggtgttctgataaattttataacacaaatttgttttacaaatcaactttgatctatgctttaataatatgtacgacattagcaaagtcacatgtgtagtaaatatgtgtatgtggggggcggcttggatatctgtgtacccaaaggatattgatagataacattttatgaaaggttatgtatgtaggtctaaaaaagttattcaacatttactggcaatgaatactttacaaattcaatcctgcaccacaaacatttaggtgtccccaaagtaagagtgttctttcacctttttctctccccacctgcctcataacagtagccaaccccagtccggtgctgagcacatcttcccggcatttacttctcgacacagctatcttaaactaaactgctcatttaactttaaaatctccccacctgagcagctccgtgccccctcctaatcctctatgaagaagtcagaaggatgattacaaaagcaaatctagccggacattggtggagcatgactttattctcagcactcaggaggcagaggcaggcagatctctgtgaatttaaggccagcctggtcaataagagctagttctaggacaggctccaaagcaatacagagaaaccctgtctcaaaaaaaacaaagaaagaaagaaagagagagagagaaaggaaagggaaaggaaaggaatggaaaaggaaaaggaaaaggaaaggaaaggaaaggaaaggaacggaaaggaaaggaaaggaaaggaaaggaaaggaaagaaaaaatctatatggctgtagctgtgtggagcggcacacatctttaagccaccaccacccccattcgggaggcagaggcaggcagatctctctgcatagcaagttccaggccaacaagggttacatatcgagaccatttctcaaaaacaagcaaacaaaaatctatgagatctgtgtataaaccaatacaggggttggggattgtgtcatagctggtggagtgtttgtgtggtgtatatgaagccctgggtcctagccccagcactgcaaagactatatgtagtggtacatacctgtaattctagaatttgggaagcggaggcaggaagatcaagaagctctaggtcatcttcatatagtttgaggccagcctggactatagggaccctgccctcccaaagactggtgagatggttcagtgggtaaaggcctgtgctgtctgatgatgcacacttaatgacttgtgtttgatcctcagaacttgaacaaaggttaaaagacagaatgccacaaagttatcctgtaacctccacacctgggccatggcatgtgtgctcacacaacacacacacacacacacacacacacacacacacacacgcacgggtggggtgaggttagggaggagaaataacaaaattactaaatacaattttaatataaaaattaaaattaaaaagtaaaaccaatagagcacaaaatatagcttgtttcactctaccctgtaagcgaggcttcgaacacttgtcatccctgttagcctcgtccccataggctcgtagtgtggtgtgagcagatatagaaacagtaaacacttccttgcagagctggatgaggattacctgatcagtctgttctattattttatgtctttctgaatgcttaaaatctttagtaataacaaaatttttaatgcactccaatcacaccatttcgttcccaccctcctcttgctcaaattacttctaggacaatggctaacccactactactaaattgctactaatttttaaaaagatttatttatgtctattttctgtgtatggttgttttgcctgaatgggtggatgtctatataccacaggcatgcagtgccttcgatagccagaagatggcactatattccctgggactggaattacagacagttgtgagcagtcatgtggatgctgggaattgaatctgggttctctggaagagtaagcagtgctcttaaccactgagccatctctccagccccaactgctactggtttttattaggggaaaattccaaacccacacaaaaataggaagaatagtatgatgagccccttgtgcccagcgcctgcttctcgtggccactgaggccctacacggtggcgtgttcccactctcacgcttcctctttttccatgactctctttagtggttgctggactccaagcaccctggcatactttccacttttttattctacaaactccttccctttcagaaattgaacggaataatcttttcctgaaatgttcactttttttagctttcacgggtctcatcggagatgttatatatccttggggaggtcacccctgtttgcttttttttttttttttttttttttgagacagggtttctctgtggcttttagaggctgtcctggaactagctcttgtagaccaggctggtctcgaactcacagagatccacttgcctctgcctcccgagtgctgggcctaaaggcgtgcgccaccaccgcccggctggaggtcacccctgacatcgcagccagtgtctctgacaagcactttcacaacaccttgtcccagcctttcattccacttttatctcacaattctgtatctgtctcccaacgccaggctgggagcttccaagcaagagttcagtggggaccacaggcacgtaaagctgtatgagacagactctgagggaagtgatgatgccactgagagcacagaccaagtccactaaccctgggacaggttgcctcctcgatgcaaggcacgttttgaaggatatctaatagttcatcaggaaaaggccagaatacaagcaaatgtggtattctattgtgaggacgagacttaatctgcaggatgtgttcaggcaacgtggtagatgaatcagagctaaagggtaggtctttggggaaaggtaacaaaaaggggcttgaagtttgttaagatctgggttagactttgcgactggcaaggaggtaatagaagatggactccacactcaactcacctgaactcaaataatggagacttacaaagtagctggaggctacctagctcagccattcaattttcccactgaagaaacatcctcaaccactggtccttgtctcctctctccttgttccttaactcatcaggcagcagagagaaccaggagggcaatggaaagagtaaggaaggccaggccttgtccatcctcagagtgaatgagtgtggccacaccctggccttggtcagaggccttcccagaattagaaaacggacatcccagtgctgatccaaaaccccaaatgtgccacctccctaagcctggtgattgtctggcttgtggtggcctcttgggagtgggccaaggacattgtgtagagctcccgggaattcccaaattcccgttagtgcacttaccacccactcaaaagctgatggcagccaacaagcaacactgtaccattaaggtgtttgtcaagaagctcagctgggtgttgtgggcgattctgagggccctttttagactggctgcaacagaagaagaagaagaagaagaagaagaagaagaagaagaagaagaagaagaagaagaagaaggagaggaggagaggagaggagagaggagagagagagagagagagagagagagagagagagagagcttttggaagcaatgtagcactagagttggggtgtggcatgccaaaaagacccctccctgggaggcaggacactaccctccattctgccccccaacttgctttgcatttttaaataagtgatttctcctccctgcatttcatttttctctttagcaaaaacattcccgtgaaattacatgatcttctaagtttcctgagcagcgcatttcctggctttttgtattcagtaggacttttttcttttttccttttttttttttaaatttacagtaggacatttttaaaaagtagttctaacatgggggaccagcagcaagggccctcagttgcaaggctagaggagaaaggttttagtgggaaaggaattcaagggaacagacccagtgaccaaggtgatcctgggaagccaccagagagactgggacagcagaagtgccaagggtggtagctgctgtaccgcagagtgtgggcacaagaacacagtgacaacattgtcaaaatcaaaagctttatgttcatgaattagttttctactattgctacaacaaattgccaccaattcagttcaataaaataatctagctattggccaggtattgtggaacatgcttttaatcctagcacttgggaggcagagggcaggtggatctctgtaagtttgatggccacctggtctacagggaaagttgcaagacagccagagctatgtaatgagactttctctccatacctacagtaaaaattataaagctgatcattgagttccattcctagcaccacaaaagtaagtcaggaaatcaggaactccaaataggtgttatgggatcgaagtcaaggagtaggcatggttgcattcttctgcaggctccaggggagagagactgtgccttttggcttcctgggctgcttcatttcctggcttgggaccttctgctgctctcatcacacctctgaccctgactcttctgcctccctcctctaaggattcttgtgattccatggtgctgtccttggtgccccagggtaatcttcccattggaagatccttgatcccatcgggccagtctcttttgctatgtgacattcacaggctttgggaatttggatgtgaccatctttaaagaccattattacctaatgcttcatgtcactgaggcctcttaccaattcttttattgtcctctgttaccagatgaggaacacgatgcagagagacgtgaagtcatttgcctgaaggcactcagctaagttagcaatattcaatatgcggcaggtatgtaggtcccaagtgaaactaccttcagataggaccctatccagccacaggtgtaaagggaatttgtgtaagtctctggaggatgcctcctaatgtctacagcttcatgcatgcaagggccatgctctgccactgggccattcccctagccctcctgcacactcctgagttagtatcgtgtggcccactccttcacgtctttaatgactcttattcagatgtctgggacctttcccgaccacattctataacatagcagtcccagaatcctctgtctcctcagcctgcgttactcttcatcacacttattactattgatcctccaactagatgacaactagaaagtagctcaagtgttttgctctgttacagccctcctacgcagagctggtccatcgtaagttgctcaataaataccagtggggctggactgatggctcagcaattaagagcacttactgattttgtggagaacccaggttcaattcccagtatccacatggtggctcacctgtaactccagttccccagggtctgacacccttctgacctctgtgggctcctgcacatacggggtgcacatacatacacactctggatcacgtagatatatacctatatatttacatttttaaaaataaaaataaatattgaatgaatgaatgaatgaatgaatgaatgaatgaatgaatggacaaaaaacaagttaatttgatgtttgggaggtaggaccaatgtttttggtttttggggggtcttttggtttttggagtgtttttttgtaaaacaccggatataagtagtaaggaagagcaaggaatcatgggtcatatgaggtctctgcgttggaaaactgaggaagtgatggtgcaaaattctggtataggaactgtcttagttggggtttctgttgtgtgataaacactgaccaaaaacaacttgaggaaagggtttttttgttttttgttttttgttttttgtttttttccttacacactctgatcataatccattatgaagggaagtcagggatggaacctggagttaggaaccgaaacagaggccatgggggaagctgctgactgacttgccccccatagcttgctcaacctgcctctttaccctactcatgacccactcaggcaccacctccagtgtgctggccctcccacaccaactattaatcaagaaaatacccgcccccagacttccctaaggcgaatgtgatgcagggacttcctcgattgaagttccctcttcccatatgaccgtagctcctgtcaagttaacaaaaactaacagcacaggagccatggcacaagcgtatgtgccggtgatctgagcacttcaggcatttgagaagcagaaagtcccaggaagggggaaatcttcttgaccatgtggataccctaaatcctgctgcttgctagttttgtaactctgggtaatcaattaatctgtctaaacctctgttttctcatctgccattcctccctcatgggctgctaccttctgagtgctaagcacaatgccaagggcagagttggcgcctagataataacatctatgatattattgtaattagatcatctccgcccaccaaaaagttgcttcttctggagtcaagctctgtgtcctgcagtctctcattctgcactctgtgcccgttgggcagctccccttcatgttatctcattctccttgaagcccttctcctccagcctgaacatcgctcctgcatccttgtaggaccgtcctggtttgcttgctttcctttggggagttgcactttgtctcctctactccgtagacaaacccctgagcctggacctgaaactctcttcatgctgaaatctgtgctttgtcgccattgctcacattggttatggatttgattgcccagacagtatgtgtgtctgtgtatgtgtgtatgtgtgtgaatgtgtgtgtgtgcatatatgcacatagaggtcggagcctggtgcttgccaactaggtgaggctggttggtcacagagccctggaggcctgcctgggtcttcctccccagtcctgggattagaaacacgtgtcaccctacccagcatttgtacttgggttctaggattctaactcgggttcccctgcttacactttactgaggtagtgccctctctccccggacctcagattctttgatcacagtctttgattctctctttctcattccaatccagagttccaaatcagacaccggattgtctggtccttcttgatagacttcaccagcagcctttctgacaatgccagcaggctcttcactcctgatcagacccctgaccatctttccaagtctctccttcagctggactaccccagtaaatggaatgctctcgaatgcctcagggaccatcccagtagatgggatgctctcgaatgccccagggaccatctgttgtaattgatccagcttctctctcctgcccaggccatgatggttttctaagtgtactccttagcctcagcaatgatcttctctttccacccccatcgatacttctaatctcaccaccgcctctgctgtctgccgctctcttttctcttagggccacatttttttttctctccttatgctctgttcctctttccctgtcattcactattcagctctgacttctcaggaactgaaatccccaccctgtggccagcggaccaatcacactgttctgtctatgatctccgtatcattggttcagcccagctattttggtcggctgtacctgcaattcttctcactttcctctgagttttacacctctctcggcacttagaaggtgtcagacatcttggagttagttaactgctgtcaaggttagacttctgacatggctgatgattgattaatgggtcaaggtgtaaaaagatgggaagccaaagcataactgataaattccagcaaatactttttttctacctttactagctaccaggatttatgctaaatgtcttcgtacattacttagtaagccttctcaagatggattcctttccttggtgctcagacagtgcctcccaggccaactgttcattcatttactcattcatgaacttggtgactattgaatcagacactgtgctaaatactgtagcgggtttaaagaacatgacagtctctattccccaggaactcagtgtagtcggagaaaacagatacaatgagtgaacaggtgtgatgcattgtagtgactacatttagcagagtagacaaattacttcagcaataaagaaggccacctacttctgccaaggtttttaaggaaagctgaatgaaagtggggacatttgaagtaggccttgaagtttgctaccatgtatcaagagaatggggtttgtggccaccaggaagagcctggaagtgttaaaggacaaagaatgtttggagttggtgtcttcggtgtgatcaggggcttcttcctagagaaggcagtagaggctgtgagtggtagagatgaggtaagcagtgaattcagttcactagtctgtgctccatgctccttagcagagagaatactgcacagggtcttagtgctttgatgacaggatctaacctgggagtcaatgttagagcaggtgaatggctgagtgacttggccacttccccaacatttgcacctatcagtgtttgaattttatggctggtcctaggtcaagggtccagtcccaagtgattctttgtcatatgaccactttaataatagatgaccgtataccacgcctcttcatttccctccttccagcctcttcacctaccctcacccaaagtccccgtcatttttacatatttctcagactgtatcacccatacctgctgggtagttccaatttcatctccacctggatgtcttccatgacctcacctttctctttatccctctggttcctgtggacaagacagctcactttctcccacagaatcctctccatgtctgttctatgaagctgtatcttcatcacaggttcacttgtcagtttgtgagctccttagtcatcactgtaccccaaaaccctacacagtgcctagcgcgtagtaagtgtttgctgtttgttggatggacacaatgaacaactaaagcatgtccaactctgtcccaggcactggataaatagagatggaaggagccttcccacaaagagcttagagtctggtggatggtgatacggaatggtcggggccccataatatctgtaataggggtttagtgagcacagaggagagagaactcactttgcctgggaagtcttccagaggtagtaatttatggattgaacattaaaatatgaaaggtttttgccaaactaagaatactcggcagagagaaacgtatgtgcagaggcataaaagagaatcggtgttgggggactgtgagtattgacactgtgcagcgtcattctgaaggcaaaacatgttttagacactgaatatgagaggggtaaagctgtcgctcttttgcggatgttccaagactattattctggcaatttggcttttaatcagttttatcacaaggcagtgaagatgttatagtcatctttggtgaaaaataacaagtaacttacttgtagtttctagcagctaccttctaaaaatggtttgatttgacttacagtaaggggcagagtcacaataaagttgtttgtatagaaacaaaacccaaaagctctcggcctcagttggtagagtgcttgtccagcaggcaggaagctttgggtttgacccctagtgcccaataaaactgggcatagtagcaaatgcctgcaatcctagcacactatcggaggcagaaggatgagaaagttcaaagtcatcattgactgcaacgtacaagtccaaagcccgcctggcatatacaagaagggaatagcactatttcccaaggtacctctcctaatctcactcatcagtactcagatggccttctgaagatggacagaaaactgggttttgtggctgcaagcctggctttgggggtgtttctgacacattaagaatgtagaagtttcactcattttccagtaatgacacagggaacctcggtgctctcgtttctttgggtttccatcccctctaatctttggggtggggcaaactcctttaccttgctatcctgtggtctctttgggtttccctcccctctcacctttggcgtggggcaagctactttaccttgctatccttcagtctcactgttcatgtgaccttcactcaaatctcttttagtctcttgccctttttactctctctcgtttttttgttgttgttgttgttttttttttttttttttttttgtagtgtttgagattgagcccagtgtctttgtactcactagttaagagcccaaccaccaagtcatatcctcagccattttttttccctttttagaaaatgactcctgggttcaatccccagcgtgtgtatgtgcactcggacacacacaaacatacacatgcatacacacacacacacacacacacacacacacacacacacacacacacagttgacatcaactaagacttttaggaagttgacaggactaagaaccgacaaccctccacctgactctccaactgttagcattttactgcatttacttggtctagctatctctttctctctctcaaaatatatttatgcatttattttggagcccattaagcaccagttgcagataccacacattcttatgtaagccttcaatgtgtatttctgaaaggcaagaaattctcttacataatagattttcctatgcatttattatttatatatatatggaatatgttgctttgcttatttataattgtttataatggattgctttgtggggagatggtttagcaatgaagaatatatatatatatatatatatatatatatatatatatatattgcagtgtgatgctatctatatcagattgactttaggcacaatatgttttaggagggaagattccatgggctattctacctcagtgaattagctgttcctatgctcttacatgttaggcttgggtcagtggaaagcatcaaattcatgaataaaaggggcagagaaaagctctgaatgctgcgttagagtcattctgtagccaggagatatccaatgagagattggcagtgggggagtgagtccatcagagttccatattctggagattaacggaaccatgtctgcagggtggagtggaggagggggtaaaatgatccccgcttttaaaggcaaatctctgtcacatggggcggagaggaacctcctccagcataacgcatcattttctttcacacgtctttcagagctggttaaaatcctatggctatctgcttccgtatgagtcacgggcatctgcgttgcattcagggaaggccttacagtcagcagtctccactatgcagcagttttacgggatcccagtcaccggtgtgttggatcagacaacaatcgagtaagatttgcatagggcatcgtgcctttgaacctcctggactctgtgttcacatttgtgatggtcatgctatgcccgtcctcctgcctccttggaagataataccaaacagtgaccttccatggttcctgttctggttcattctccacatgccatctccgtccccaccccacacctcctacccccatctctctgatattaactttatactgtgtaactggagacaagtcgcttagcccttctggtcctcagtttcctcgtcagtacagtgagggagtgggttatagaagatctctctagtctcatcaggtcccaataactaagagctctctcagccatcctctggggtgccctaagatgtgtgtgcatggttcgcttgacacagagaagtgtggagcaatcacaggctggcagttcttgtcccacttttcccatttaccaagcacctgctgggcgcctgcatgtgccaggcactgtgcttagccccagcctcctactcagctgttttgtgaaaaacacagtcatctggctatgccgtcctagggctcagaaacataccaaccccagggagatgccagggaggcagtgacataaacccagccatgagaatacttctcaccactcagggacagcacaaagaggttagagagcagaggctcacaaagccagcctagaaggagtggccagggaggtgaagacctaggggaagtgacgtcgagggcatggccagctgggttagttgctgagtggtccaacagaaaggtggctgaaaggcgttgttgtgccttaggaatcaggagtttgtggataaactcaggagattggtggaaacaaagtcagaggcactgaggggaagagaccggagctgagatggcaggagaggaaaaagttttgagaagcctgagaacaaaagcaagagtaagaaatgggtggtaggcagaaaaagacacatttttatttgtttctcgtgggagaaagttgggccagcaatgcggctcactgggtaaaggtgcttgttgcaccagccatttgttaggtccccagaatccaagtaaaggcagaaggagagaaccagctgcacagagttgttcctaatgttctatatgcatgtacgcatgcatgcatacagacacacacacacttgtaggggcctggagaaatggctcagcatttaagagcacttaactactcttgcataagacccaggttcaattcccagcacccacgtggcagccacaacctcctgtgaccccagttccaggttctggtagtgtcttctgacttccaaggtctcctgcatgctcctgctgcaccaacatacactcagacatatacacacccatgaaaaacaaaacacatatttaaaatagaaataaatagaaaatttaaaagacgaaagtagcttgataatatttggtttggttttgctttgtttgagacaagatctccctacatagcccaggctgtccctcaactcatgatgtagaccaggctgtccttgaactcacagaaactctcctgcctcccaagtactaggattaaagatatctggctccattatgcctagccttttttttttttttttaatagccataggctgataaagtgggcccagcaggtaaaagtgcttgccacacaacctaatgacctcagttccatccctagatcccacattaaaagggaaaaaaaagtctcctagaagttgctctctgaccttgtgtgtggacacatacacactaataatagtagtaaatataaataagtaaaaaaattgaactaaaaagaaaatctccgtgaaagccacttgaactgtttcagaagagacatgcaggccaggcaagcatagagagagcagaagtgaagttctaaagggagagatataggagcccacgtgagggtggaggcagatggcagggctggctgaggacacgggagaactggcaggaggcgaaatggaaaatgcacacaactgtggctcaaaaatcagttcatccctcagacaagttactctgggataggggactcagagtgctgggtttgcgatcaaatcctgagtccattattccaagctgcaaaactcttacaacttggtgatccgtaattccatccaagcgtttcctagtccctccttctcttgctgtgatattgtgaaattcagggacagtccatccgaaggctccctggaggctgtcagcaacatgtttgctcctgggccttaccagtgagtggctcttagatcctagcatccttcctaggcccaggttattttgaggcatttgtgcgggcttcatggcagtgcatcctgggccaggagcactgatgtctctgctgaggcaccacctggccttgggttttactctgttccagaaagccccaggcctgctggacagggttcaaaccacagcaggtggatgggaaaagagaagacaaagggaaggagctaaggaaagaggtaacgttgcctgcccacacttctgcccgcacttcttttgggaggatgggagcagtattctggacacacagaaaggaaaaggctgttcacacggagtccaagcctggatcgggatgggtggaattcagagggctccaccctagctctgtgactttgggcaatagtggcctttccctgagcccatctcctgacattgggctctcaggtctcgctcagccttacagtagcagggatggcttttgcttctctttccagggtatatgagtaaaaggaagcttgattcacaatttcaaatactatttttgagtgtttaccttgggaaatgccacacatttattccttcactcattcctccagccacatagctcctctaactctactctgtgctaaactgcatttaaagtcctccaagtcagtgaagttgcagccctgcctcactgacttctgtgttccaaatgacctgattcatccacgaaatcctgacgacctgagttcgatccctgggatccatgtcaagggagaagagaacagatcccatgaaccatcctctgggctccatgtataccatgacatacagcactcctcaacacattgtgtacatgaaaaaataataaacagctgggcagtggtggtgtacgcctttaatcccagcactcgggaggcagaggcaggcggagctctgagttcgaggccagactgttctaaagagcgagttctaggacaaccttcaaagcaatacagaaataataataataataataataataataataataataataataataaatttttaaaataaaaattctgctaggcagtggtggcacatgcctttattcccagcacttgggaggcagagacaggtggatctctgtgagttcgagaccagtctggtctacaagagtgagttccaggacaggttccaaaaagctacacagggaagccctgtctcaaaaaaaccaaaataaaaaaataaaaaaaataaatattctaaaagcagtccaggtgtaattgtgtctgcttgtaatcctaacacataggagacagaggcagaaggatcatgagttagaagctagcctcggctacctagcaagatcccatctcaaatcaaagaactctgagagcacacgaatgcatgggagctgcaaatgtttactcgggtgtgtgctgttgctgttgtggcagtccattactgccgtgagtgtaggtcactctctgagtgagtggagcacaccaagatgagtaagaactagttcattccctctagaggctttcatatgtggttaacacggacagccttcttttttccattgccaatgacaactgcttttaacagctgtgagtgaggtcaaacactttcccttccagtgatgccaggctatagttcagtgggtcagctgttagacagaacataaaatgcagacagtctgaccctagtcagttgtgggtttttaaatctcctgctcaggcccctcttaaatccccagcgatgttccaggcttgttccctggtgtgcctttacctgataatgaacaagtttatcaagatttactgagttccatgcactagactagctttgggacacaatgacaaatgtaacatggttcctcaaagaatctgccactattagaagcaacaaatcaatatctaaaatcacaatataatgtaataagtgctacagaaggttatattctacgtcctgtatctgctcagagatttcttttgagtcaggatctggctgtgtagactaggctggcctggaacacactgtgtagatagatcaggctggcctggaactcactgtgtagacagatcaggctggcctggaacttttgatcctcctgcttcagccttccaagttctgtttttctttttgtttgtttgtttaatgtgtgttgatgttttacctacatgatatctgtgtgaaggtgttgagttgcctggaactggagctacagacagttgtgagctgccatgtagatgctgggaactgaacccagatcctctggaagagcagtcagtgctcttaactgctgagccatctctccagctccttgagccacttcttaaacacctgtagtgaaagacatttactgtccttcatgctcttctgttgtcgtgttgaagagttctgattcagtcatttattcagtcagtctgtcatcggttaagaaatcattattgacccctttctatgtgaggcactgtgccagccctagggatacaggggactcccctattcttatccagctcagagtatggtgagaaaaacaaagaaggcagatgtatacctttcgggaagtgggaacctggagaagggaacattaaacaagttaagccatgttattgttttacatcagttcatcagggaagctctctctgaagggcagagaccggaatgaagtaaagggacaaactacatgaagacagacagacagacagaaaagcagacagcaaatgcaaagactctggagcagagatggttactatagcaaacagcgagacaccactgtggctggctatctgacaggaaaagggtaacacgctgctggatacatgggcgggggctagaccatgtggagcactgtagtctgagctgggagttagacttttattgcagttatgatgctgacgaggaaactggggttcatgttgatttcatcccttgcctggggtcctcgcttggtagaactagaacttacagtgtctcctgaatccagggtcttaagtgtttattaaacttaagtatttctccttgggagagaatgaattaatgaatcagtccatctgttaattccttctgagggtgtgcagagtgaaagtcccagaatctaagctgagtatgtgcactgccatccagactggagttgtgagctgcacaatgccttcctaggatgttcagtgaccataatgcctatgtgtatgtgtgtgcgtgccttctctctgcccaggtggatgaagaaaccccgatgtggtgtccctgaccatccccacttgagcaggaggcggagaaataagcgctatgccctgactggacagaagtggaggcagaaacacatcacctacaggtgttgcagccccttgcttcctccctggttttagttcccatgctcactctctttttcctgcctaagtttctgaagttcacatggtaggtatgtcttcaggtgggggagtcaggacaaaggccaggcatgggacatcaggaccagatgctgagagcctgtaaccctgtcttccttgtgacctccgcaggtgactctggcttcaggtttcctggtttgcctggtcctttgggaattagctgtgttctatttagacacctacagttactgaacacggggtataaagtgtttgtaggattctgctgtgtaaagacccaaggcagagctcactgttcatgcttataaactgccctgcctctgctggattcccaatttcagcctgacagacttcacccaacatgctcaatgcagacagagtctcaactgtttcttaaggagagtaagggatggagacatagggtcacaacagcgtcactctgtgagtggagaagccagggcagagcagattctgtctccaagccccacaatggctaacacgaggataatgaaagccagcacagcagggccagacaccaggactcacagaggcttgggcagggacctggctaggaaaggctccaatgggctctgcttggcacctctcagaactctgattccacctcaggtcaattcccacggtacagtcaacgaacccaagacagagatcactgggttacagtaagagctttccttacgaccagaagtagatatcagaacaggatttttttttttttcttaaagagaaggaaacttaagaggcgtctaggttagaagactcttgagtctcccaaagacgaggaatggatcaagaggaaggaaaaaaaaaatgtttctagctctgttctgatcttacctctcattactcaacttctctaggcctctgcttccttcctatggaacgggtaagatgatccatgtacccagcattcttggggcagagaattcataagtagtagtgttccattgtggaaaaccgtgtaccatagatacagttagttaccttaaagagctaagtcaggcgttggattaagtcatgtgctgccctacaccagctgctgatacaccagcaatagctagttcttttccacttaaatgcctctgtactatttgagtatgtttgcgacttttacaaatgtatattatgtgttcggagagaaagagttagattttaaaggagtctgcctatcaattgctgcacattggatggaatcccttatgcaacataagccttgtcaggaataaaaaatctgatgaaaacaaagctattctgtgggcaggggtgggggtgatgctcttcctgaagaccatttagcctggtcttcggcccccagggcatctcagtagaattccgggactcgaaatgtgcagaccactggaccatgctggctctgacagccctttcagtttcactggtctctgattctgcctttctttctaatgatccttctctctttcaccagcattcacaactataccccaaaggtgggtgagctggacacacggaaagctatccgtcaggcttttgatgtgtggcagaaggtaacccctctgacttttgaagaggtgccataccatgagatcaaaagtgaccggaaggaggcagacatcatgatcttctttgcttctggtttccatggtgacagctccccatttgatggggaagggggatttcttgcccatgcctactttcctggcccagggattggaggagacactcattttgattcagatgagccctggacactaggaaacgccaaccatgatggtaagtacatgaaaggatggggggcaggaggggatgtcagtgctgggatgtttaattgtcagggaaagatgcaccaaggatgcacttggagacaccattaatgagagacctgcttcccagaacttcttgtttaaaaaccaaggactcaagagagtgagagctgtgatctctgttaatattcaacacttgatcctgatccaccaggaccaggccataaaggtcattgagaccacctagaagttggtctaattgggctgaggcaggattgaaccatgaataagaaaatggtatgtcagaggctgaagaaacagattaaaaggctttaacatagaactggagatctgatgagttctcgtctcaaagctactctaagccatggcccaacctttctagcatcctcagataactttccttgcactactgtgattctgtggatatgcacagaacatcagtcagtatcgggcagtattgccactcatcattaaagaattcatccatatgaactaagacactcacttagcaaatgggaatggacactatgttgtgtccatttaaatttttatattacattcatttatttgtatgtatgtatgttgtattggtgtgcacacgcacagctctcatatggagatcagaagacaacttggggaggtcagttttctccttccattgtgcgggtgaatctcgggaatcagactcaggtgaccattcctggtggcagaacttctttacatagagtcatctcactggcccaataatctatttattagacttatttggttagttattatttgtgggatgagtgtatcacatagaaagttcagagaacaacttgtgagagtcctttctctacttccaccaggtaggtcctagggcttgaacttgggttgtccggcttggtagcaagcatctttatccactgagctgtcatgccaactgttatgtccatttttaagatgaagagttcaaggctcaaatggtataactggtaggaggcggtgctggaactcaaactcaattcaacatcaccgtatgaaagggctaaggatgtagttcaattggtagagtctttgcctagcattcataaagccctgggttcaatccccagcataatcaaagagtggtggtatgttcctgtaatccgagtatacaggaagtggagatgggtgacagattaagtaatctctaaggtctcgtccaatgctggtgtgacatggtataagtcctgcaaagaccaaggggtatgtgaatatttaattaaggagtaggcagcgtctgccctctgaaacccagagtcaggtgtctatataagtaaccaggccataaggcagactctactgaaggctgcagtacatgtgccaagaaaatgcaactagaatcagggagattcagccttcagattatagtagatagtaattaatggatgttagggttctaaggttcataccaagtacctcccacacatcatgccataagtaggtattatcatccttattttacagataggcacacaaaagcatagagaaacattattctatctaaggccccatagttagtcagtagttaaacaaggctttgaatttggatattgtaaccctggagcccataccctcagccaccactatgagtaatagtttttctgtatgcccgtaataggtttctccaccaacacagtaagtcagatcaagcctaacagaaaaagtgtaacagcgggtttatttgagcaaagcgacttctggatgggttctccagttcccagagatcaaggccagagaaatcacacacccaaactaaagcagggagattgtatagcttgtaggcaaggggtgatgacatgtctgccacaagctgggtttttgtccaagtatggtcaaaagttgaaggtttaagcagagacttgggctgctggcaactggggaggaagctgcagcagtcaccaagaatgctgtcttgggttgtgggtgccttttctttgttggagattctctgagaaggcagggtttggagagaggggtcgggagagaatggggctttccagatcaagcatgagtgaggtgaaggttccaactaaacactgagtttccatggatctcaaaccacagggaccatgagactcaccagggtctatttagaaacatggattcctgtccctggagatccccatccttaagctggataaagtttggaaaacaaaggacacctgttcctaccttggcacagcttatgggtacaggcaggctcttctcggtccctccctcataagccatgtctggtgtaggtagatgggcttctcccttgaggtcactccagaccactgtgtgaatcagggctttgctcctctcagcatctctccaacactggtccagtgccactgaccaggcagttaagagactgttcagtttctttgtcctcttccctcttcggattttgttatgtttcctgtgaagctccatttcctctggcttggcgtcatctctcctatgtccttgataactttcctgaccctttgtgtacctagtctttattttactcttatttttggagtggtgtcaacaaatgactatgactactgataaggagtcaggggaaaaaatttatcattttcaggcctgttatgtgccaggcaccattagctgaaagggttctagttttagttctggtaaacacaactgaattttctttgggccggggtgttgagactgggtttctctgtagccttggctgtcctggcactcactctgtagaccaggctggcctcaaactcacagagatccatctgcttctgcctcccaagttcagggattaaaagtatacaccaccactgtctggttcacaactgaattttcaaagggttattttcctatagaggtgctagaaagaagtgcccctccctccctttctgccaagccccagggtctccacagtcatgcccactccttgcttttgaggagcttactaggtcagcctgcagtcctgagaactggtgtgtgtggcgtgtaggaaggacctagagcctgtaaatggacaccattgcaacacccctccctcctgattacctcacctttaatgaacaacctccagctgggataggaacaggggtcaggacattgctctataaaaccagaggtgaactgggtaccacttacaagtagatccctggctgacgggagtgaactgctgagcactaccccaagaagggttgcagcagtagaaaggaaccacaatttattgagcacctggataatgtggcatttgattttcacatacattcagtgagggagggagcaagtgttatcttagctggtgttatcttatccctccaagtccatcacccttcagccccaaataagcacacagatgctatgttaattataaaactattggccaatagctaggacttcttactgactagctctctcttaagtattaacccataattactaatctgtgtatttctacatggccttattttaccagagaatgcctggtgcgtcctatcctcctggtctctatatggcatctccttccatgtctacctttcccagaattctcctcatctcttagccccgtctgtcttcttgcctctattggccaaacagtgttttattcatcaaccaataagagaaacataatgcagaagaacatccccatcaggcaggctctcctgggacttggtctgattactgggttgctttcattatggaacattttcaaactctctagaggaaggagcctgaggaggatcctagatcaccatcctctgctccagtgaccaacactgttgttcctactttgcccaacacttccacttttattttattttccgctgagattttgttttgttttctttattttatgtatatgagtgttgggcctacatgagtgtaccaaaagcagtgtccttggaggctggaagagggtgtcagggtcttatggaactggagttacagatggttgtgggctgtcgtgtgggtgttgggaaatgaaccctggtcctctacaagagcaacaagtgctcttaaccactgagctagctctccagccccatggctgatgtattctaaagcaagacccaggtataatatcattttatatatgactactttagcatgtcactctaacaaagaccaaattttaatataaccacaaaatcagtatcaaactcaacaaggttaacaacttcttaaaatctaatgcccagagctctggtaaagtgttcaagcatggaaacccgagtttgactcccagaactcatgcaataaagccagatatggtgtcatatgcttgcaagctcagcactggagaggcagagacaggggtatgcctggggtttgctagctacacagcctagcctagtaaggaagcttcaggtccaaggaaagaccctgtcccaaaatacaaggtgcaacaatgcccaaggttgacttctggcctccacatatctccgcacatacaaacacacacacacacacacacacacacacacacacacacacacacaaacacacaccaccccagagtgccactgaattgtgcatatggttctcattccctccccccacaaaggcgcaagctagcccatcccacctaaagccattttcattaaactttgtccccatttctttaaaatgagtcaaccagtgaagtcagcagatactcggctctgccaggagggaacccagccctctgtgttccttcctaaaggaaggtgacaagccaggaagagccttcgtgaccataccctgcttcacagaacagagcctttccacttagctcactaactcatactccacagcggacttaggggaggtactgaaaaagtcacacagttggaagacagcagagccagatgtgaaagtgagatgccatatctctgacagtccccccaagggtctgcagcaggtggtccagggacagaacgtggaacactagagtagttttggcattgtccccgcctggtgctgttgccttactgtgtcaaactcaggcagctgagccatttttctggggctactgttcccaagaagctcagtcttggggcagaatacacacccgtggctgtaattaatgaaggttggaaaatggccagcacctaaagctgcctgatattaagatgctgacagggtggagaaggcacaggccagctgggagagccaggctggtttctggggagatgagcactggggtgaactttaaaggaagagagggaattttaggggacaccgctgataagcacacagaggtgaaaagaaatgccttgggtgggtgctattggagtcatgaagacaggaatccacaacaaggaaagttcatcttgaaagaggccaggtccacgggagaagccaagcagactgtcatgctacagggcccaggacttcctccacacagacacctgggacgctggtcctctcacacagctcaacacacagtgataatgagtaatgatccatctgcaccaagccctggtgtggcactttgtttaccctgactcattaatccttgttgctgttcttaggaggacggcggccattattctcttcgctgcagagaaagggctcttaaaatgccacaccgctaggacatggcagagctgcagaaaccacactctgatcactcagctcctgcctccccctttttggggagtgaagaccctaagagcctcttctccatagctgacccccacctgttccctctgttctctcacaagttcagtgtggctgctctcccctcccctccccttccctcctctcccctccctctgtgcagtaggatgctgcttccccgagtttctcttccttttggtcctgggaagaaacccacaggcctctttgctttaaggatttcactgtatacagaataggcacaagccaaggacaatggctgagagtactcaggggctctctggccccctgctgaggtccctgtggatggtcccaaggagaggcctggtcaggagagaggccctgaacagcttgtccaggtagagcagaaggccaggagcagagccagggcaggctgcaggaagctgagctgccttctgccggctccagcagccaccttggtttggagtgaagctaaaagatgagctcactgcttccctgctgtgtgaagggaccaggccctgaggaaggagctgggggcaacctggctttctcctgtcagcctgcctttctcagcagaaggccggcccaggcttttggccaaccttgcaatgatcttggccagcccccattcctctccattgctcaaaggtggcatcatggatgacatggatgacgttgttggtgtcagtggagagtcagtctggcctgtagcattcttctcatttcccaagaccttactcaaaaggccagacaactctcatcctcatccgactctcccggggccttgatgggctggggtaaggcaagtctgccagggatactagacccagagtgggcagtaaggttcctgacccctggtggcctccctggacttcaaggtggcagaaaggaacggagccatgcctaggactgggagataagaggtaggtctcatgggtgaacaaatgccagaggtgtaagcaggagtctgtaactgagcagagaggagccagatgcaatgccctgcccaactcctaggccaatttctttcccaatactataattacctaatgtctacaaattcaggccttgacctacccacgacttaaaatggaaattgaagggagctagctttaagaaaatctggttgctgaagccccaccaacctttcttgctaatgggtttactctggcccaactcaggtctttcgtgctgtagcaacagagcaactacatcatgtgttttacacctgttagttattcagtccccacccaaccaatgagttagtccagcttctccttcctacaaatgaaacgttgagggtgaggtgttgacccaagcttgtaagtgtggcactggaagtggcggtgacctgtcccatctcagggtgctcacaaccagcacacctcaccgtccctcagtttcatgttcaggatcccgtgtcctgccttcagtaccagatttccacccgttcttgtctctgcaccttgattttgtgggtaattccaggaatagggtcctgctgtccccctaccccccagagccctgttcacaccagccaccccaaggactttttcttgtattgccatggcttccttgactctgctgacccagcagcaccccagcacctgcaccccaccttctgaactgaccccactgatctacctgcctcggatcccctttgcctctgattctctctccaatggtaaccagggtgacttcatcatgcccccctcctctcctgctaccccacaccccgctatggccaagaaactgatccaaattcctttgtagggcatcacagagccctgcttgccagcctggctgacctcatctctccctggccctcccttcgtgctttgttctagagccaagtgaaatgaactgcttgtccctggacctggtttatagcagcacctctgccaggaatggcacactccaccctcttcctccctaaccctgaatccattctgcagaccaatgttttacctttcaagactcagcttaagtctcacccatgtggcgtcttccctgaacaccttcctccaatccaaagggacttagtagcacagacatgtagtcccagctgaggcaggacggtttcaagttcaagaactcaaaatcaaaaagtacaaagaggtcttgggatattgctcagtggtatatgcaaggcccaaaggtaccaaaaaaaaaaaaaaaaaaaaaaaaaaaaaaaaaaaaaaaaagggtgtgggggtgtgtgcaagggggaaaaaaagagcccaaaagaaaaaaaaaaaaaaaaaaaaaaaaaaaaaaaaaaaaaaaaaagctctcaatctttacacatgtctggatgcctggatactgtgtagcctttgcagtttcttcatgtacccctctgcaccaatcggtacacaggcaaagattgtgtttgatttctctatgtccccagtgtcgaacagaaggccaggggcagagacaggggatatgctaagtgtttgatatgctaagtaacgtctgttactgactaatactaagtgggtatcctggatacctcgttgtccctctccacaggcaatgacctcttcctggtggctgtgcatgaactgggccatgcattgggactggagcactctaatgaccccagtgccatcatggcacccttctaccaatacatggagacgcacaactttaaactgccccaggatgacctccagggtatccagaagatttacggtgtgtatagtacgggggaggggggtatcactattgttaatgtgaacattgctgttgcaggtgtggggccactgttgttaatgtgagcatgccctgtggcaggtgtggggtcaggatctttgccattgtcagaattgctactgtgtctctgtgctgacttaaatgaggtccccctagcacactgggaaacctaagggagagaatttgagctgtgactgggaaaggtaaaatgaggtgaggcccactcattctcaccctttcccacccacctccctttaccagagggggaccaggcacactctggggtgcctctaacctaggaaagtcacacatctgcttgaataatggtagtaagtattatatgtgaccttgagatgaaaagctagcttgctgtcctcataagatatgaaagcctaccatgtacaagtcccaccggcatggagagtctaatcaagttagttgaaatgggagaccagttcatttgagcaaatgttggtcaacactgcactggaggtgggggtccctctggaggaggtgcgacaaccagggcccccatcacaacccacggtgaagcagcagggggcagggtgggcagccagtactagaagttatttcaaaggtggaatggtcaggatctgctgacagatcagattgagggaaagaaggaacaggtcaatctaatactgactttgctgtgggtgtggctcagctggtggagtgctcacctagcatacatacatgaagccctacatttggtctccagcaccacatgaaccaggcatggcagcatacacctgtaatcccagccttctagaggtagagtcaagaggatcagaagttcaaattcatcccctttgctacataaggtgtttgaggccagacaggggtacatgagatcctgtcttttaaaaggggggggcactctggtatttgtaactgtagattaccccaaagatctgagtgagcccatctgggaactccctgaagatctggagttgtagaactcccctaggtgatccacaagagctgtccaagttgagaggcatgacaaagggaaggaagaaaagagacccttaagggtacccagtctttggagcagggtggactcctctaacaatgcaggttaatagagaatccccccaggggcagacaaaccaagagcacagggccatggaaaaggaggagcatggttcaaggcaaatgtttccagaatcttgctgtccaacttgtgggtctcaggccagtgacatgggtttcacctgagaccttgaagacatattgtctctggctccaccccaggccctctgagtcacaacctgcattaccaagatgactcactcgatcaacaaagttgataactgttggtttccgaaacccagaggtcattggtgaacttggcaagaggtttgggtagaaaatggagctgacgctctattgcagttgccgaagaatgagcgtggttagagatcagagttcagccagtgtgaaggagggtagcaaaggagagtgtgggacactggccctcaggaaggacaagtttcttctttaaaagggaaagatgccagccttggggatgggaaagtgaaagtccctatctaatggctgtttccatctattttcccaaagactgagagttaaatcagggagaggggacaggaagtctgaaatgataaacttaacctagaactgcctatgtagtgatggggcaatggcagatgacagtaagaaagagccacgtcctctctaagacacagcccctctctccaggacccccagctgaacccctggagcccacaaggccccttcctacactcccggtccgcagaatccactcaccatccgagaggaaacatgagaggcagcccaggccccctcggccacctctgggggaccgaccatccactccaggtgccaagcccaacatctgtgatggcaacttcaacacggtggctctcttccggggcgagatgtttgtgtttaaggtaaggttggtggaccagggccacccagggtgtaccttcccctacaatggagctgggcaggctcctgctctatctgctcttggctgctgtagggcctggacaggagctggtctagtgtccaggacccatagtcttctggagctgacaggtcaatcaacttggttctacaaggtgacagagagattggtgagctgacagcttccaaggagccaatcagtgctcaagaacatgctggagctggcatcgggtctatgaccttgaataagtcaccttccttctccagacctcagcaatacaacctggggcagccattcctctgacaaaggatgtgtgaagattaatggctaggaagatgcagagcagggcctggtcagggatggcagtctatagctcctgccagggcatgagtgacaggtactggccaggctatctcgtgttccttgtcatgtgagccaaggactgcctgagcatggtgcatggcaggccaggtccttggagaaacagactctgagatagagtctggaatgagagattctgcttaaggacctttaggataaacagatgtggtcaggaggggcagaaagccagtcaggacagtggaagaaggtgaggagacacagacttggtgccaactcagcccctcatgggaagttctggagctagaatggcccatcacagtcattccatattggatgcaaaaatgaagctgaagccattgcaaaagccctgaaagctgaatgctgcctgctggtacagtccttcaccaaatggcagctggacaatggctctccatgacactgggtgccagaggaaggctaccccatttcctttcctaaggtctccccaggaagcttcaagcacaaagtaaaatccaggccatgtaggctagcccagttctgcctctcactaagtgcctgtctgtaggcatggccttcgtccttcctgaagaccgtgtgtgtcagattgacttgacagagttgtgcaagtcagaataaaacattttccaaactggacctgaaagtactttgtgaaacatttgaaaaacgctgagtgatacctcagtggttaagagcacttactgctctcgcagagcacctgtgttccgttcccagcatccacatggtggctcacaactgcctctagcttttagttccagagaatccaatgccctctgttgatgcctgcaggctcatgcacacaagtacatgcttacactcaggcacacacccatacacatgagtacattttaaaagatatcctatgtctgtactgtcttctgtgagtcatattcctactgcatcacttgtatttccttgagcctcccaataaagtgttcacaggcaagtgtgaattttatcctcccctttaccacactgatcccaacggatatcagtgactgtctgctgccctcccgtggccactccaggccttggcagtagtcgcctttctagccttcccacacccatctgctgtgtgtctcatagtccttgaacagcaggaggcttaagtgaagaattacatcctgtcttctaagagttggaagcagcagatggaccggcttgatgggaggttgtgaggctgagccccaggcttggtgttggattgctgggcctgaaccctggggctgagatcaccaaattcagaggtaagacctgccacctgcgtttctcatttcccccattcccctcaggatcgctggttctggcgcctgcgcaataaccgggtgcaggagggctaccccatgcagatcgagcagttctggaagggcctgcccgcccgcatagatgcagcctatgaaagggccgatggaagattcgtcttcttcaaaggtaacgtggggcatttctacgccctttttgacgcttcctttttcccatctaaatcagaagaggtggggtgggaagcatgggaagcagatgccctctgaagggccagatccccataggtaggacctaggtcatctgggaaaaccaagtcaagaaagtgtcaacattgacggggtaaaaaaaaaaaaaaaaacatgcacatgaagtacagggtaagacaaagaagaccacccagcacttgctggaaggtcactctcgaagttcggtaagagtccagacagctggctacccaggacatagatgggggggggggttaacatgcccagcctgggctagcccacttatgagctgtttcacattagtaatcttgacttggccctgcttaagctgagtaagatacagatagtgaaatgctaggcaagcccaagagaagtgaacaaggcagctgaatgtagtggtgtgtggaagcccatccaagggctcagaagctcaccctacagcctctgaggccctaccttggagagctagaagggtcctatgagagccatttctgaagagttgtggttgccagcctagaattcagtctggacctgtcaggccaaggccggaaactcactgcaggtttctgagtagcacagaaacatgggagaggtggcatgcggtaagatggggagggtaattcagaggacaatattcccatgaggccccagccagagaggaacagcacagctaaagaacatgggacgctgtgagaagacttggggcctcatgagtggctgagtactgagaaggaaggaaagaggctcagaaatgataccggcacttctaagggacactgggaggaagaaaggtgatgaaaaggaagccattctggtaggatgaggagctctgaaaacccaatttggagtagccagggaccacggaagagcacaggatatgatggggtggggcttaggtcaaatgggtatggggctatatcctcagagttagggcacataaggcagataggggagtgtgagactctgagagagtgtgcagagtggctgaagtcctgagtggatgtgtattgtttgacatgagccagccatgtcaatgactaaggaactaggacccatgggaaactggcaaccttccccatgtgggtcagacttagaattgatttattgtggtccaggtgggaatgtctgtgaacagttagccaatgtgtcaaaaaactagtacctgcagcttcctcaatcctgagactgctcgcctatggagacttccgccggcactaatgccttatgccgaggttccgagttgttgcagtagtaggtgctgctccatcacaacacacacataccctacctgaggccggccacaggaagtagtagcgtgtgatatcacaggtgtgattaccagaaatgaaagagggtcaagacaagtaggtaggaaagtgtggtggctacacccagcacttgggaggcagaggcactaggatcactgaaagtttgaggccagcctgagctacataattaattccaggctagccagggatttagaaaaaaaaaaaaaaaaaactttgtctcaaaaaggaacaccaaaaccaaaacagtgggacagagagcctgtgtagcatggtgcacattgcccaaaatctatgattggcttctcgagccccaaatctgctgggccaggggctaagaaaacacacattcagactttatgaagacaggcaagtggaccacaacatctcctggcactgggtggctcctgaaggctgattctagactctttccacaggtgacaagtactgggtgttcaaagaagtgacagtggaacctgggtacccccatagcttgggagagttgggcagctgcctgccccgtgaaggaatcgacacagctctgcggtgggaacctgtgggcaaaacgtactttttcaaaggtgaacggtactggcgctacagtgaggagcggcgagccacagaccctggctaccccaagcccatcaccgtgtggaagggcatcccgcaggctccacaaggggccttcatcagcaaggaaggatgtaagggccaagctgaggtgggaatggggagttaattttagtggttctcagggcccagacgtatgcttctgggtatccagatttcagtaatgtaacttggtaatagacagctgccctaaatggaccatgttcacatagtaaattaacttgcagtgatggataggggtggttcaaaggtgctttttcatagggtttgatgggtaggctggcaattgctcaccatgtaccatcaggcagttaccagcctgtctccctgccagattagaaacttctcaaaggaggctcaggctttaccagatgcaagcacccatgactgcctgttacactgactcttgaacagggtggttgggttcacagaccctgtccaccactcctaagtttgggcaagccatcgagctatccgtgaagtgggaatggtcacagcatttacctgtggactgtgtgataaaagattgatagggtaaattacagagagcatttgcgtaatacccaccacatggtctatgcatgtaaaagttgtagctgtcctcatcatctcattagtgtttcagtctgtgtaagatgacagaactgtcattcgacgcatggtaattaccgagagccagtttgtgtgggaggggctcaggacagaagcagtgagacttgcatagttatcagtccactgacagaaaataacgtcacaacaaagcgagcctcagagacagatgacatcaaagacgttgaccaatgaaagtcctggggagtcagccaatgaggagagtctgagtgagctgctttgctgtctgtcaactggctgggttgctaaggctgttgctgggagccttcagggagctgcctggggagtaattggagttgcctggcctgctgcctgcctcctttgcttccagccatcaaagccactagaagagtcctaagaacttgtatctgtgttacaaagtggtatatgtcaagccctccccacaccccccaaaatatctgtaattgtggagccatggtgtctgctgctaacatgaaattttgctcaattcccattggcttggggcaagagttagactgaggcactaggagattgctctgcgcaagccttaaactgagggcttgatctgacccttataggaagcctgggggcacagtgtaacagacctgtttccagactaagaatcatccagactgggcagtataaattaaagcacttgccagctctattcaaaaatcccttagtggtttcccagcacctttgaaccaacaagtgagattctccatgtcctggagacctgtctctgctgttagttactgtgcagccagtggagcactgcaactcacccagccacctccgttccagcaggccactccctccatctaccatgccccttggagcttctctcttgtacactggcaggcacatcaccccaggtccacattagtccagagtaggtgctggggcgcgtctgggaatggtggtactgagtccttcccatttctgcagattacacctacttctacaaaggccgggactactggaagtttgacaaccagaaactgagtgtggagccaggctacccacgcaacatcctgcgtgactggatgggctgcaagcagaaggaggtagagcggcggaaggagcggaggctgccccaggatgatgtggacatcatggtgaccatcgatgatgtgccgggctccgtgaatgccgtggctgtggttgtgccctgcaccctgtccctctgcctcctggtgctgctctatactatcttccagttcaagaacaaggcgggtcctcagcctgtcacctactataagcggccagtccaggagtgggtatgagcagcccagagccctctctgtctacccagtctggccagccaggcccttcctcaccagggtctgaggggcagctctagccactgcccaccggggccagcagggccctaggccaggttcgtgtgtagctgaagtggtgggtgcattggtctaggctgagtgtggggcagggagtgatggtggctgtgccccaggttgggtagctggcacccagttgccagccttctggcctgggtacaccactctcaagggaataggccaggccctgtcaggaggcaaggatcatgccaggaggtgcccctgaggtcactgcatcctatggtgtctgcaaggtacgggagctccaggcctggctgggacccagccctctgaggcaagccagcactagctctcaccctcccccctttcggagatgccaccaatcccagtcccctctgccaacacctgctggtcagatgtcccttcacccctaccccactatcctccatggctgcagtgcccctgctgccaacacagtgggcaaaagcctgggtttcccctgctagccaatagcagattcctcaggaaacctgatccacttgtcaggtctcccctgagacccaggatttagggtcacatgctgcaggcaaggctgtggcccagctgggtctcacaaggaccctgctgtcatgtcgtgaatatttaaatgtcctgtcactactgtttaaagtcccattttgcaaaggctatttgaggctttaggtcaattagaggtgactgtcttggtgatgcggccagtgtgatggcccctccttccccaggcattaaggaccacggtgctgcaaagagccactctaggaccctgatactagcaagggtcctgttcaggaggctcaacagctggggcaggagctgaccctggttctggaggcagatccaagtttgtgaccatcctctactccccttccatgaatgttgtccccaccctgctccagcctgtcttttgtggcatgggggtttagcctgactagttatgtggagcagagacggctctagagccaccattgtcatagcctcagagtaaaggaccagggcagccttttaagtaatccatccacatccccagtgaccctgaggcaactcaatttcttggcctggagtgggtgtttgtgctccggtcttgaccctggcagcccagctcactgggcccatcttcctgcactgctcttagaaaagggtactcctagctggtagcagccccaagctcactccctacccccacctcaccccacttttctttctttctttcttctttttttaacctgaggcccttcttcacatctgacaggagttcctaggttttggcttgacttgctccagtctggcagccatgcttgtcattgggcaagaccaatgggttcagtgatgtcactggctctctgccaaagtccaaaagcagtgagaggcaaccttcagggtgctagtgggttgccaacaccaaccctgccctctgagcctgcatgggccttgccctgccctggggcctctggatttgggttagcttaccctgtagcacagacagggactcctgccgccctgggagctgtggagtaaaatctatcgtcccagaagcatctatatgggtccactgtgtcccagcatcctcatcctgttttttctcatttcggcaaagggcaggctccctggggcaggtggggaacaactgcagagatttagtgattcataggtttgtacagtgttttatactttgcaaagcactttattagctcacacctgttcactcacatgaaggccctgagaggctgagggtaacactcatcttgcccttagaagcacagggaggtcttatctgcccctgccatccagtggccctggctgggtctgtgttcccaactgtgggtccttctagggtctgagataaatgtcttttctattcttctcttctgggcctccctcccccaacttcctggtccgtctcctcaggttggtgctctcacttcttgaaagctctaggccccgcaggctccctgttggctcctggtactccaagaccagttgagaacaagcaggagatggaggcaggcagcccaggctgcagatgtaagggatgcagggccgggcccagagggctcagcctagaggcttccaatcttggattcttctgcaggcagtcatctgtttgtccatcaccccaggccagagcagtcagaggggcaaagcaccgggcccccagagctcagcttcccctcagcctgggtgacatcacagcatttcagtgtcggtcacattttaaactgatcagcctttgtataatgttttttaaatcatttctaaataaaacagaaatacagtgtcttttccctggggtgtgggaacaaagaccagggcccaagtgtgcccttaagaagcttcgggggagaaaagggtgcacgggggtattctgcagttgtctcatgcatctatctgctaaccagcaatcagatgtcctgcccccaggtccctcaggagtatgggagggtcactgtttgcatgcttctctggagacagggcacacagggccgtgacctgggacacctgaagcagctcagttctagcgagggggaaaccagagttcaacagcatcaagggtcctgccaggaggcctgaatctgggcctggtggttctggttcaggtaggctgccccaggacagagctggaaaggggtccgggagtgatctggtttaggggatggtaaggatgggaacaagtctgaggttctggtcagtcccctgaggttgccctgtggacctctagtttccaggagcttttttgaatctctacccagagtgaggaagacaggaaatcatggggtgagggggacaaaagctaggccaggcccaagaggacacggaggccccggggaacctggtcagtaccaggatgtgcaggcgattagaaagcgcacatcatccagtagtccccatggtccgggctcaggctgaggctgctgcggaccctctggcgctggaggctggggctgcgcgggctctgggccttcctggccaccactcaggagagcgcccatggtctgtaacagaagcccatcaggcaccaggccaggtgacaccccacccaccaccaacacccttccccgccctcacctcaggcagcgaagtgaaagcggatctatcggcagcttggcccgagaggagcggcgttatgacgcagtcccggataacccttcgcacgccaggggcgggcccacggagctcaggagaggttgggcgactggccagccccgcccaggccccgccccacagcatggccgttggagccaacgacagggggcggcctggtctccaaagtcagacagggatgtaacacactgaagctgtgtgcctgtggcttcacagtgcgttcgcccggcagggagaatactagtgattctcattctgaggccggggaaagcagaggcagaaagaagatgggttaaaatgtaatccgggagggcatcactacttccccttgctcatcttttcttagatggagtttcactacgcatacctggttgacccagaactccccaggcctctgggattaaaagtgtgccccatcccaccctcaggtctcctatcttagtgagggaaagcactgcatgtcaatcccacccgacttccccaagaccccaggaagtgccggggaaaggtgttgcaaaccgaggatgaacaaacagcacactgagcatggggggaggcagtactttaatggggtgggacacaagacagcagaactctcatccaggagccacaactcaaagccagcatgacacggcaagcctttttataacaatagtctagagatggcacggatgaagaagggttgggcgcgctcaaccattcagctctggtaagctctctgccacgccctgctgccagcgtttggtacatactagctcaggcatggtaaatgagccaaagtccagagccaggagcccacacagcagcatggaaggtgactcatgtgaggctgcagagagaaaatcgtattatcagtagctgttttacagggtacatgctgccccacccttagacctgttctagttcagtcattgaaaagccatacttgtccccaccaaggttccagatttaactaaatcctgtatatcaaggtctagcctaaaattctgcatatttgaaaagtaaaatcaattctttcctcattgggccacctttttccaatttattcagttaatgatcataaccttgagctctgaacataagagatagaagcaaggaaggttggtgagaacaacatgtgcttagaccagtctctcagaggccaggctgaggccaaagctttggtctcttttccagaactccctattacagctgatgcaaaggccacaaatactagactggaaaacagatctgctctacaaggattaagtgaaatctctcttattggaggtggcaatcattgtctgataatgagactggaatgcttattgtgtatgcaggcatgtacagaggttgatgtcatgtgtctttctcagttgcttctccaatttatgttttgagacagggtttctcactgaacctggagctcatctcttctgctagactgactggccagtgagccccagcattgtagttacagacatgtggcacacagcctagcttttatgtgggtgctgggaatactgcttgcacagcaaggactttacccattcactataataccttcccatgccaatttggcatcttcattgcgaagtcttatgggcacctaaaaacatgtccaaaaaccaaagaaaacggactagtcaagtttcccttcctttccaatacccttttctttctattgtctaacagcacagacaaggactaccagggacacaatgacaagtggctagcagttctgcttaactttaatacagtttctataattgacaatatttttctgataggtatcaattattaggctatagaaacttcttttcaattgttactaagaagcttttgtctttaatgattgtcactgtctccttacaaaagtctacgttccaaacaaaagacagggcgtgttctgatcccataaataccgtctggcacgtaaaacgctgctgaacaacttctcaggctgggtgtagctcaacagtacagcatttgcctagtgtgcataaactctcaattgttcaccagctctgacagcaaagttagtcagagtgaataaatgtcctcctcagaatttctcaaagtagcttatttaaaaacacatgcacatagccaggtgtggtggcacacatctctggccacagcacatcaccagcctgcattgaaggacactatctttaaaagaactcaacagtgctggactgtattccacctacagtcagaacctctgagagatcacactaagaatccacataaacaagcaacccaactttcactaaagctcaaaatctcaggctcttactgatactggaatttaaagcccttagcctcaggaaaacatttatccttcacatatcagtattttcccatctctctaatctgtgtgaggttcttcctcactctcttctccatatttagcatctcctcatcacctgaaacagactaaatatcactcatgaaacttctataatcccagaaatttccccaccagtttcacaagctgcccatatggggacagttaaggaactttgtttctcctttaatggctaaaagttacacatagcaactctatctcccatgcacacagtgaacccctccggatatagaactacactctctgattacccccatgcagcctcatccatgggcatcagtgcaagcaaaggcaacaggataaagggaaagtccttccatggtaagtaaaggatctatttacttgtcacttttgggtttctatcttcatagaggtgtacctggctttggcaagcattaagaaaggtccctggcagactgacagaaaggaggccaaactacccagcatttgctcctgctgctcttccagagaaacgtcaagtctcagtccagtctctcaagtgatgagagtgagcaaacatgcccagcccagctggctgtgtaatccacagaagtctagaccagtggttcccaacctccctaatgccattaccctctaataatctctatgtggtagtgaccccccaaccataaaattatttgttactatttcagaaatgtaattttgctactgttatgaatcataatgtaactacatgatatgcaagatatctgacacacaatcctaggaaaggatcattcaacctccaaagcgattgagacccacaagttaagaacctctggtctggcctggagagttggctcagaggttaagagcactggctgctcttccagaggacctgggttcaagtgccagcaaccacatggttgctcacaaccatatataatgacagctaggtggtgatggtgtgagcctttaataccaatacttgggaggcagaggcaggtgaatctcagtgagttcaaggccagcctggtctacagagagagttctaggacagccaggactcttacacagagaagccctatctcaaaaaacagcaacaacaacaaaaaacccaaacaaacaaacaaacaaaaaaaccaaccccctccaaaaaaaaaaaaaaaaaaaaaaaccccccccccccaaaaacatcttgtaatcccacaatttagctgctttaaaccatgatttcaatacaaaatacatctgcagcctacttttaagagcacccttagcaatctgaggccgtctcagtgattaagaggagccttctcaccttccccagccaactgatcttttctatctcatggcttagaccattagctaaagacagtggacacaggcaacacaaactgcaaaacacagccagtgatcaagtgagatgggtcacaggaaaggtctgccttgaaagcccagtctccaaggaagactgagtgtgagcagatgacagaggacatctgtggctctaagttggtatgcactttcactctcacatctggggaaaacaaacacaacatggctttctttaaggatacatcttcttactctcctctcaaagacaaagtgagccgggcatagtggcatatgcctttaatcctagcacttgggaggcaggggcagtgtggacctctgagttcctggccagcctgacctacagagcaagttccaggacagccagggttacacagaaaaaccctatcttgaaaaacaaaaaacaaagaaggcaaagttacctgtcaatgagggaatcccgcatgctggtggcaatagtgctaggcttggcctcgtttagcttgaagacgctctccaccactgacagctctgtgctggttgtgtccagaccacagaaagcacaccaatcgttcactaccattccagcagcaatcacctcgctccctcggttcacagtgcctgcctgcagaggtgtgagctcaacataagtcacagaaccaaaagcaaattctctcacctcaagtgaggactcttctcctgaagtctgttctatgtctcagggccccagtcccaaattaaggaaggtaatgacccagattcccaaggactgacataagggattgcatctagtagacaggggtcagaagacaggaaagcttaccaccaggggaacctgaagaagggaggacagctcgtcctggtcctcgatggaagtcttagggtgcaccagacccccttgattactgaagacacagtagcttcctactaacacctggtcagcaactgtctgtctgaagacctccaccttgagcacgtcagccaggatttcttctgtttcctgttggacaaaggtactgtgcccaggatccagaacatgtagggcaaatacccaggagttctctcagcaagccagacctggttccctgagtccctttttactaaacatctgcgcatggaagcctcactgagcaagacatgggtatggctaagagtctagactcagcctgaagcccctaaaacctaagcaagccctgaaaaacatgactcttggctccatgtcacccttttcactaatacataccctattcaactgtcaaccaactatcatggcccatggcccaagactgaataggccaatctccccaaccctgaaggattaatgccctacccagcttgatactgacacacaaaagccttagtattcctaggaaagtaagagtgctgagataactaagaaaatacacaaataaaacccttaattcctgccatgggggaataatggctaactactagctaggctagtcctgtaacttccagaccaaactgccacctcaccctgtccaagtctgggtggactaaggccacatagtcattgcaggtggtaacattgccaagggctgagagccgctcctccacccgccgtatctgcaccgaatctggaaggctgtttcggatatgctgcagctcctggtccgtggtgttgttgggtactagtagcccatgcctgttccctggaaagaacacaattgtaaggtgggataaagataaaccatgaacataggaaatgcttcctgggatatctcccattctagcccaattagctttcctaggagagctcaaagctgaagccccaacctacagatccatatacgaaccatgggtccctagacaggcctcagatggccaggaatctattccaacaaacatcaccatcttatcattattaactgggggttggggggaggtcaggactagcaaggaaggcacttggcattacttttttttttttttaacattacacacctacctgaacagctaaaattttcaaagatcatcaagtaatagcaatagtataaggaacaactgaaactatgctctgacaggagcatacaatggctgtctactccagataattactgtcatcatctaccacactaaattcccacataccctcataggtattatatatcctaaagaatatttgtacatatgttcatatttacagagtaactattcctaaaacaccaaactaaaaattgtctacctgttatcattataaaaccttctgtccaggcttaggagccacagttttaaacttcaaattactttcattgaaagagagcaaagaccaggctaagatctcccttatcacgacagaatttgattcatatcctaagagcatggttaaaggtcaggatttttatttctaaagatcagagtactgaagtaaatgactatgtagagtcaccattcatgtttaacgcttaaaaaaagttttaaggtaaatacataaaggaggtcaggacaaccccaacatgcagattccccccccccaaaaaaaagtgtcagcaatgaaacatgatggcacacacatgctaatcccaaaacttgggaagtggatgcagaagtatcaggagttccaggccatttctagctacagggacagtgtggctgaggcgaacatggaaggatcaaaaaacaaacaaaactaaaagttggaggctgttcaaaagtgcttacaggtcaaagtgcaagggtgccattcaagagatgtatttagagaatgtaagatgtaaatgtagctgaagtatgacctgggaaccttagttattgcgatgaggcagaaattaatgctcaaaaacatgaagcaacttgtccataatcagaggcaggaaagagatgagattcactatctaggagtggaacttggtgagtcacatagttctcaagtgtcagtttcttcaaacagtcaaaggagggcaacccctccttccagcatcgctgtggaggaaaaacgcgaccaagagtgaaggcacttaatgctactactttgctatgactattctcgggaagtctgggctacagtgttcttgatctgcagtgagactgagtcccacccacccctgagagattccagcgtccaccgagaccgcaagcctggagatccccgggtcactggggtaagctccaggagttaatgattgagattcatagcgctccgaggcttcactcgtccctcggcgtcaaccccccgccttacccacacacatgcgcccgatgatccggcagccggcgatggatgcatgcaccacggggatggtttcagagagctcgccctcgaacacactggagaaacatggggtcgctggttactgctggggtccctccctctgccggacctgtcgctcccggcatcccttccctcccctccccttcccgcccccaggagccccggcctcacctgtagaagttctctgaccctccgatagccaccaggcagtaggtgttggtgagcttggcaaagcagccgacctcgcagttgttctcgaacgacgctctgaccgccatggaagcctgggggctgcgcgaccgcagggtctgggacgacagaccctctcaggagccggtcaacccacctcgctccctcagaccccgccctctcggacctctcaggcctcgggtcgcgcccaccgcatccctccaggctctcctgccccaaaccctcccgccccggggcccggaaccgagcctcgccgccccgcgtcccactaactcaccaaacgactccaatccccacacgctgcaacaacttctcccgtaactagctttccgtttccgcctcctcccagcgggcttccgggagcacgcgggagcccagccaagcatgcggcctctctaaccccaccccttcggaggactctatggttgctcgtggtttggcttggctccgcccacccccgcctcccgatggttgtctggctttcgtggtgtcttctctccctattgggtctttttaggagtaatcagccagatctgaggctgagcagacgagaacctcgagggaaagagggaaccggtgtcgtctggctgaggatggattgatgagggatgtgtttaccgagtgaggccggagaaggggcaggtttgggaaaggagaggatcccaccctgaccgtgcggacggaaatacggatccgaagcagaggcgagaggcccgggctgaggattggggctaggctcactcaggagagtggccagtatggagaaacgggagcaggacagagtggttggaggaggcacgccgagagccataagaaacaggctgaagaagatattggagagaggaaatgtgtgaagcttggggagactggagaaagggtctagggtgggcaaagatgtgagttctgacttgcttccttgatgtgttcttacacacataccacacacacacacacacacacacacacacacacacacaagcagccaccatctgtcctggggatagtggtgtggcccattttcataagcagaataaatttggctgagggtgcctcagaatgccacagcaaagaaggaagaagctaagaacctcagatcttctttatgcctttcattcttctccaaggaatcctattagtctgaaaagggcctgaatgttgcccttatccccccccccccatcttgtaatcccacaatttagaacacatcaggttgctacttgctctaaccatatctgcctttattgatttgtaccatgccctgtctcgggcaagcggtgagttcaagagaaaggcccctgaccagctgcagcctgcgcttcaagagacactcagcaagtggcttgtgtatgtgcgtctacgtgtccatccacatgttctgctcatcttccccgtttcaccccagactcgctcgtttccatctaactctaccaacaattctaactctcttccccgtctgcctctgtcgacaaccccatcctccaggacctgcttgtaagtccgcttctctctgatagactttcctggtcacgccaccatctccgtgaccctccgtccctagtacactttccatttgatacagctctgccttgttttcctcggtttatgcatctaagcagtcttgcagctccgtggcatgttcagggcagggctttataagcagagttgggatggagttaatatgtgtacttacagcttgtgaatctcgagggggttctgcagtgtgtactaaatgcacgtattttctgtggccattcatttaggcagacaagactaagtacctacaactaaagttctgtttgagttaatcacatagagctatgtgtactcactgtatgcatctatgggtgtacctagtcactgttctgtgtctactgtatgggcactggggcatccttgtagtgtctgtatggtatgtacatagtgactgcaggaactgcagatactgtgttttgggtctttgcaaacaaaacacatgcttaaagccaggggccactgagctggcagagttccctaccctgtcatttactcagatctgcttccaaattaaccatgcaaactctggacttcagctcccgtacttatagaatgggaagaatatcctccagactctttggcctctgtggcagacagaacatgaggaaagaaacgtcatcctttggaaggcatgataataagatgcacacactgtgccatcactgtggctcttaggcctaccaccttcagaggtcgacctgtgatgactgtggcttcattgccaaatgcaagagaaagtaaccagagtgccaaggaaaaaagatgaaacactcctgggactaggtggatgaggcacctaaaaattgtctatttcagattcagacatgggttctggaaaaaaaaaaaagaaaagaaaagaaaaacaaacccaacaacatggaaacccaagagggcagctgttgcagcatccagttattcttgagatttcaatcagccataaaataaatgttctggtttcaaaaacaaaacaaaccaggggtggaaacttaatatagctacatgccaacaagagatccatctagaggatacagagaatgagaataaccggtgtgcagtgcccagccccagtgacatacagaaaacactcagtaactctgggttctgtttgtatgtatgcctgtgcgtgtgtgtatgtataagtcttgagcccagagagtatctgatctgagccactagatgcctcccttccttatgcagcccagctttatactctcatactacagtcttgaacctgaatatgtcacctatctgtggatggaggaaggctctgcccctgctaggagcagagttaggactcaaaacgacttcggagctgcttgaatttggacttgttgtacttagtgatgaggtccagtttgctgtggcccaaggtcagccgtttctcaggtgcaaataggtcattgctattactattttgatggccacttatgggagctcccgggaggcctggctcaggtctctgcctggcaccctgtagttgatgatacttggtgatgaggtccagtttgctgtggcccagagtcagccgcttctcatctgcagaccctactccggccatgcgaactgggtttggttctgggagaccattgggtccaggcccctcactccggaatgggccaaatttggtgatgaggtccagctgactgtggcctagagtctgccgtcgttcatctagacttggcttgtcaggcctggctgaagaattggcatcaggcagtattttagagggctgggccttggggttttgtggcaggagatccaattggccatggctgtggtttaagggcagcttcctgtcctctagacccagatcaccaggtcttagggagcctgactcaaggacaccctgaccctgggacaggagatccagctggctgtagctgtggctcagggacaatctcctatcatctagggcctgctcaccatgctgaagggaacctgaattgggggtaactctggaattggaacctcctgcttctcctgctttagggaaggggacaattcgatccaggtgatcatgactctggctcagagataccttcttctcatccactgtctccagagctgtgccaggtacccagcgacctcgtggaaggatgggctcttgacttgctgggagcccattctctggaagccgggacaatgctgggactcccctagtgaagtggagaagggggcgggaacatgggagcagaggtgaccccactgccagggtcaagggactggcactacagtggttaagggcaggagaggactgggaccatggagatgcccccagcttgctcaggttggccctgtagggtccaggagttgagctatggttaggatctgaaagctgacggtacagggatggtgggctaccagcttcatggtgggcaggacctggggacaaggaccccatcaccatgtcactgcagccaccaccccctggcagagcgagataggaggaacggcccagaaaaggtgaatgcttgatactgccgaggctgttactggagggtgaagagcccgtagcacttggaattccaggtccaaaggccagggtcacaggaggaggacgaggtacccgggaagacagtgggtcctcattgccacagaagccttccacaggctgtgactcggcatacagacatcggaactcccggtcaaagtcttccacaatgtggcccctcagctgcagcaccatgctggtgtgagcctggctgcaaagccaggtgaagctggggacagagagccagagtcagggtcaagggtgagggtgtccaaagtcgtcctatttcccatgtgcaggagttactttctatgccaaggcagtaagtagaatgcgccccatctgccccttgccctgcctggtccctagcacacagcaggtgcctaggacatgtttgaagggatggatggaagaaattcaaagcgggcagatatgagatgcccttactaggtcatggcgcagccccccaggcctccctccttttaatcatctcacctgtaactgcctgccaccacctgctcacagtcaatgatgacaaacttctccagggcctgcccggtgaatcgtctacccgccttgctgcagtacgtgtctccgcatgtgctccgcacacgcatattctgggccaagagcagaagaagattgatggaaggaggatgaccttaaggaggcagagctcaggctggagagaccactcagtagttaagagcactctctgagaggacttgagttctagtcccagctttttctgtgaggtggctcacggctacctatgactccctcacaagggcagtctgacaccctatgttggtgcactcacacacacactcataatttaaaataaaatacactgaaaaaaaaaaacaaaaaagaaatggcactcaggctgtctctgacctaaggggtatctggtcccacacagttaaaaggaactatgtgttccactcccactgaccaacctccatgctcactgaccgccagctggccctcttacactcccgattccccttcttcccatggtggaagctgtctgcccatactgaccaccagatgccccccattgaggtccatcttataacacatctccaggaagtacttcaggtgctcctgagccaggaggaggtagacagggacaccacggcggctggaggcctccatgaggtcacacagaagctccatgtcagtgaatacgtccatcaccacagccaccacctgaaggagacaggggaagttcagccccagtcaaagtatggggttgaaagccaggatgcaaaaccagaatcaaattctatattttatttttggacagggtctcattctgtaacccagtaatccaagctggccttgagctcactctgatctgagccccatgatcactgggattagaggagtgtgtcaccatgcctgccttaacctggagttcttagcttgggcactgggagaactgacagtcttgaaccactgattgtttaaaagcctttgaggaatttttctatggacagcctaacagattctcaaagacatctctagatcaactatgttagtctaaagctctgctctttggaaagctggagaagtcaggagtcagaagcagaccccagcttccaggctgattcccattattggtaccagctctgctctggtctagggacttccccagtctcttctacaagggagaaagcttcaatccagtgctgggaatttctgtgtgtttttgttttgtttttcccccaaacctcagttgctttggaaactgcagagatctggtgtaataacctatatttacagcctcctttacttccgtctgtgctaagtggatccaagcttcccgctcacttgaggggctgaggcgtgtgcctccaacacacagggcattccttaagcccgcagcggccccttcttcccgctgtgtgtgtgtgtctactgagagcaggagggacagagtctactattgcaacttggagccaaaaggaagtgggttcaaatccatattcctctacttcttagaagcagagtcttgggctcatctagcgagcctcagcttccttgtctgctaaatggagtgtatctcgtagttacaagggataaatgtgaaaacgctggactagacacaccaaagaagctcaatagccacgcctcccccctttcctgctaccttcttagcaaatagagaacactgggctatgggaaaagaaaacacttctgaggtcactctgggaatgagtggcagctcagcccagtagcctgactcttagcccaagggcagaaaagtctaattggaggtgagcaggcggggttcgggggattctccagtatgcaacacaggtctggccagtgttgggggagcaggcacgaaagatcaaagggggacagtgatgacaacagcaacaacctcgctaattatcccattctggatgccaatcaagctctgccctcctgtgcctagggcagaggcaagcttgctagcaaggctttggaggtgctggtgggatcctctctgcagcaggagtctacccctatctcaaaccctgccaggggtttcatatctattccctcatctgagaaggagccaaggctccaccagtgaagctatgctgctttgagactaggggcttcccaggtgtgactgccccttcctaatgtctccaagctcagtggcttccactcttcagtcctcctagcaccaaactaagagctttgcctatgccaaaacccatgtgcagtgcccacagccttgcttcaaccccagctgttggtgcagcacaggggattgataggcagcgggggacggggggggggataaactgagccatgctgggttagaggcagagacctctccctcccagacccagacaacctctctaggtaacttccttctagcccctctctgacctcaacttctttctaagtcaaggttgtagctcagatgttcaccatggttgagttcttagtctggggtgggggtggggggcataaaactttttgagggtctgggaaacaggtcagaagttaagaacaagcactgtgctcttccagaggacccaggttctattccctgcacatttggtagctcacaacagtatggagttctaattgcaggggattcaaagccctcctctggccgtcaatgactccagacatgttcatggtgcacacatgcaggcatgcaaaactctcatgaacatgaaataaatacaagtcttaaaccaggcagtggtggtgcacacctttaatcccagcactcaagaggcagaggcaggcagatctctgtgagttcaagggcagcctggtctacagatctagttccaggacagccagagctgttccacagaaaaactctgtctctaaaataaataaataataaataaacaaataaattttaaacaaaaaaattttttttgagaatctgatcaaggttatagactccctcccaaggtagataaggaaccctcccaataatttcccatgcacttccaggggtgaagttccagagccctatgccctgttctttgcttaattaatgttcctgagtgccaacagaaaataaagtgcccacccatcctctgacagctggggatctagcagaggtcaaagactctagtcccggtgtccctgttaagcttctgtgtggcacaaactggtccccttcccgtgagccacgtctgtgaagtgaatgaagaggtgaggcccttaccgtgtgggcctggctgaagaggaatcgcagcaggtccttgatgctcttgcccttgtccctctggaaatgaaccaccgcctgggtggggctgaaacctgtggcctgtggcacttcaggccagcccaggtccaggtctgggggatctaagtcagaagccatggggaagtaggtgcctgaggtaacttcagagagcatgctgaggcggtcatgccctacggtctctggtccctgggcctcgttgagctcgggaaccccacgcacatggccgaccatgtagtccacatccagggcactcaggaagggcaattcccgctcttcagagatgacctgaaggtaggcagcctcgcccctctccaggagggcgtccgtagcaagccttgcagcctcgctgtgctggagcaccaggggggagctctccctccaccaaggccgctttagctcctccactcggctccgcaggggtcctgccatgccctgggtccctccagacgctaagctgctggatgtgtgcatccacctagtgccctacccacctgaagctccatggcttgcacctgggttggcgactgtaggaagaagatactacctccagcttgccagcccggtgtgtatggcagggcccccaaagtgttgccaccctaagtctgaaccaggctccgccccattgcccctggccttgggaacctgtcaggtcagccccacctgtctgtctgctgttgggactcgcctgctcagggaagtggcagcgccaggcccttaaagcatgctactggctcttctccagacactccttacaggggttacagccacaagcctgcaacccctgaccctcgaaaccagcagaaattagcgctccctccctccctccctccctcccagcctacacacggtggggggtgggggggtgttcagggacacacaattcacacaaacacacacacatacctggtagatgaatgattcaagacacacaagcagatcctctaacacacagactactgaccagcatgcagatgtagactataggttcatacatgcatttgaccaaatacatgtaaatgcccaacactaacatagagactggccattactccaaacataccaccataggtactgtgtatgtcttggtccacaaacatattagacccccaatatgggttgaacgaggtataagaactctaggaacatcaacactgtctcccgctgggcctctgccataaccacggtgctgccataaccatggtgctcacaacaacctcaacccaattctgagcccatcctccaaggacctgcattaggagtcctcactctgactcccaagaagagttaaaatacccaccttccatgctccacccatgctgaatattccagaagttctgaaactctagcagagagtccagagcttgccttttttttctattttattaatactattttttaattgtcacatagtcattgtacatagtactgggttttgtaaagatgttttcatttaagttggagtgtgtcttttttgttaagacagagtcttgggcctgatatgttggctcagaggttaaaaacacttgctactcttgcagaaggctagcgctcatttcccagcacccacgtagtagctcacgaccatctgtaactccctgtttcaggaggtctagcatcttctgatgacctctgtgggaaacaagcatgcagatatgctggcaaaacacatataaaataaaaagacagtctcatgtagccgaggctagtcttgaactcactgtgtagccaaggatgaccatggacttacggtccactggcctccacctccccagtgctgggattacagcatgcatcatcatgcccagtttatgcagtgctgaggttctaacccagggcttcattagacaaacactatacccactaaacctcatcagcaaccatgcttggaacttgcctttttagccagtgttttaatggcagtgcctatgcatcaagagtggtgggctagccgggcgttggtggcacacgcctttaatcccagcactcgggaggcagaggcagaggcaggtggatctctgtgagttcgaggccagcctggtctccagagcgagtgccaggataggctccaaagctacacagagaaaccctgtctcgaaacccccccccccaaaaaaaaagagtggtgagctgccaggcagtggtagtgcacgcctttaatcccagcactcaggaggcagaggcaggtggatctctgtgagttgagacaagcctggtctacaagagctacttccaaagccacagagaaaccctgtctgagtggggggaaaaacaatggtgggctaaggtagacggctgcatatccacacactgagctccagggatgcacgcagcctggtgggaaccaggctccatccattggggctgagtttcagagaatgggcagacacacagcaagatcagaacggaaacagagcaggttctgcctcgacgagagtcacagttcatggttctggaactggtggggctgtcctcagaggacggagaagcggttttgctctgaagaagggtcatcagttggcaactgcacgtggtggcagaatgtgggggggggcggatatttatcaccctcctgtagaggggtgagatctgatgatggtgtcaggaaatcagggtccctaaagccttatcgtatatacccagtccgatatgactgaattgggttcatctgttctatggtcagatctagagcacaggctcctctgaaagagaactcagggtggagagggagggatggaaagtctaggtaggttatggggcagaggggtacggggtccagggtgtagggagccattgtctaggacctgaaatgcttccatgtcatcccaggtgccagcacagaaaccagagagaaaccaaagcgtggggtcctctaagggggcccttccctgggggtttgataggctaccagagtgttaagaagctgagtaaacaaagtcagagcatgggagggtgataagctgcgggggcaggaagagtgtgagagccctcattaggaccttatctctagattggtttgaggggagacttgttcaggcctcccagaggcaggcaggttggtgagctgctgagttcactgtttatctctggcacatagttttagtgctgtatcttgtttaccacttttaaaattatttgtgttggtttgtttattgtgtgggtgagtgcacaccacagaacacaggtgaagtccagaggacaactttcaggagctggttctcgccttctaccacgtggatcctgggatgactggactcaggtcatcaggtctggaagcaaggcaccttcacctgctgagccatctcactgactccctgttttctacttttgtgttaaaaatacacatagaatttaccctctccatcattgcacctcagtggctttaaatacacccattgctacatccacctcagagctcaccattttgcaagcctaagagtctatccacaagcaacacttccctttctccccttccactgagcccttgcagccgccactctacttttggtctccatgaactgccccagggaactcttttaggagaatcaaggtgcatgtgtcttccttcaaacagcttcttttcacttagcacagtgctttcgtttcagccatgatgtagtatgcaggttgaatgtgtatcatgagtgaacacacactcattcactgctggataatctggttgtttatacctttgattttgagacaggtctcaagtagcccaggctggcctcaaaactatgtatcctcagatgagacttccattcctgaacctcctgcctctgctccccaagttctgggatcacaggcatacatcaccatgcctagctagattccttttttgtaagatttaaaaaaaattactgaatgctggccatttcctatcatttaaatgagaatatattcatatgcatgcagagatggacctgtttatgactgtatgtgtgcacactgtgggcttgcgtgtttgtcttgaaatgcatgctggtatgtgtacctacttgtgcatgtctctgtgaagatttgtttggttactgagtgtctgggtaagtggggtagcccttgacaacaattttgtactatgtggcttgttttcattgttgttgttgttgttgtgtgcagcttagtgcaaagggcagggtgagagggtgaggcgaaaggaaaagggtcccaagcacccctgacactctgataataatatggtacaacaaacctatgtccccaaggcagtaagacagctgctcctccctttgtcctgagtgggtaaagggcaacaggagggtagacgggtggatactggccttgggctgggccttgaggtgctggccttgggtgctggaagccactgggcagactgaagctcagcccgtggctgcaatgtgtgtgtggcacagaccccttaatgactgttattaggaggaacaaaaatattttcctgtccagagggagtgtccggcgccttcctggcaacgcttagccttcccgggggccatttagtcttgtctgtcatctatctcaagctgagtggcgcctgggcaggtgcctgtcctatgggggtgggacagatgctagctatagtctttcaatggcaggatgttcaggtgttagcactgccgcacacagtctctgtggtacttctgggtcaggggagacaggattctggaggaggggcagtcagagtgcacctgatactttaagccaaggcaaagaagcttgaagagctggagagcctaggaggacaatgcggacgagtcctggaggctggctggagctggatagtaaggatgaagaggattctgtcaggtgtagtgtagcatagcggcatacaccttcaatcccagcacttgggaggcagaggcaggtggaattctgggtttgaggccagcctggtctaatgggcgagttccaggatgctgagggctacacagagaaatgctgtctcaaaaaagtcaaataataataataataatggtaacaacaacaacgtagtagtccaagcactcaggaggctaagtcaagcaggctgaaattgaggtcagctgcactacacagcaacaccatgtctcaaagagtcaaacaaacaaacaaacaaacaaacaaatcctggagtggtggtgcacgcctttactcctaccacttgggaggccgaggcagggagatctctgcgttcaagtctgcttggtttacatagtgagttccatgtcagttacaagctggccagggctacatagtgagactctatctcaaaaacaaacaagcagacttagaaatatacacccagccaatgcagagtggcaagcagggcattccaggctggaggaagaagaaggccaggatgtcctggaaggaaggtagagtctgaggagcctagcaggggactgcaggaaaggacacagagacacaccgtgaagacccttgggggcatttcaggggaagttgggaagattcaagagccaagtcttaggatgcttaggaagtcacccagtgtgtaagagtggcccgaagcagcccagttaagtgtgacttgttcactgagtgccacatgggtctccagaaggtcactgcctttcctgttgtcccatcctgaaacccccaggggctgagacccagggctagcctaccatcagaggccatagttgtgccactgaagtgagtcagatcccctggttgggacaatggttctgcctcttaatgggtgaggtcaccttctgagtcacaggcaataaatctgtaaaatgaggctagtggcacatctttcattgagaggttgtagggaataaatcggtgacaactgcctgaccaagtggtcatatcctctcagtacctgctgaattccagagcctctcaggctacgggagcaaggagtcatgtgtaggtatgacgagagatgaatagcaggggccagaagatcttctagtcagtctcttatagatccaagactggccctgaaggccaagatggctgccagccatgtcagtggagtgtgactggtaacccaccagtgcttccaggatttggctatcataggaggcaagatcatcaagatcatccctcctctgcacacgtgtgtacatacgagtattcacatacttctccagcatgctggacattttggcttttttttttttttttttctaaaatggannnnnnnnnnnnnnnnnnnnnnnnnnnnnnnnnnnnnnnnnnnccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccgatcccgtagaacagtgggagacatgccctcattcatgtttccgtaagaagaagggagggaattccactccactctgtagaaggagacatctgagagagccatcatccctcttcagcacccttacagtgtcgtcctcttcttccaaaaaagaggagtgggcttgtgtggcgatggcttggggaggagctggcctcggtcttttttgattccttctcattctcttcctccttctcccccttccctgccttggggggaattagcatgttctgtatatatctactcagtataagcctctactaggaggaagtccaccccgtcctggaagagcaggatgtctagttctgtggcaatgttaggaagtctgttggatgctctgtcagcagctttatctgcgatactagtaaagccaccattttaatgttcatctgtctggtgtcttatttcccatccattctgaacttgagaggggaagaaacattatcttctgggcctttcaggcccctgttacggttacctcttcctgcccacccctttccttttccctcgggccagtctccccaacatggatttagtgtctactttcagatactagtgggtggggggttcccgaagatgagtaagagcttgtgtctgctctggtaaagctcactgttgggtgaggaagatagactcataaataattataaactgcggattaaaccaaggaataaaccaggtgcttggggcttagcaccacgatccactctggagctccagagaaagcaggctctctgtggcatctctccctattttcccctccacattctggaaaggggcttttgatctggacagattctgggtcctaggctcaccgacaatggctcagagaggtgtccagaaagcctctgctgggtggttagtacaagggcaggtgtgactagggacaaccatggctatggtttgaggtctgctcttccggcctctaagagcaaatgctgtatggcataggcaaggcatgatgggcacagtggggtgggggaggctggtggtgggcagggacagggaggcaggggcaggagtgctactcccaagggaagagccaaaatcatttgcagctgtctcatttcttcccagtaaatccattaactctcttcctgactacttccaaatagtgcacaaactaggtttcctgggcatcactaacagccagtctcctcctagcttctctcttcaggaatcccttgtctcccttctgtccttgcaatctttggtctcaagaaagggtgcaagccggatgtggtggtgcatataatttgtcccagaatacagaaggcagaagcaggtggatctctgtgagttcaaggtcagcctcatccacatagcaaatccaaggcatcctgtgtcgtggaaaattattttaaggtgtgttacatttgtttgtgctgtagaacatttttttttttactgatgcaaagatgtgttacttttgtttatgtcgcatttgtttaactctgtgaagctgtgttattttgcctttctaaaacagttaaataaattttctaagagatctgaatggccaatatcgaggcaggagaaaggataggtggggctggcaggcagagagaataaataggaggagaaatctgagaaagaaacaagaaaaggagggaggagcaagagatcaagaagtgagaacacaaggggccagccatccaaccagacatggaagatggaaagataaggtagacagaaatagagaaaggaaaaagtccagaggcaaaaggtagacaagataagttaagggaagctggctagaacttagccaaaccaaggctaggcatttttaagtaaaaataagcctgtgtgtgatttatttgggtgctgggtggaaggcccccaaagagtaagaaaaaggagtgaaaaacatcaactgcagtcctggactacacagtgaaaccttgctgataggcggggtggggtgggctagagaggccttactgattaggagcactcgctgctctttcagaggactcggattccttgtagtaccttcgtgatggctcacgaccgtctgtaactccagttccaggagatcaaacaccttcttctggcttcttccaggactaggcacacatgtggtacacagacatacatacaggcaaaggccccggccatgattctctctatcacacctgtcctaggggactttactgaaccactgttggtgagcccagcacccagcatctgccagaactcaccttgaactcatacacataaaaacaaacaaaaaacatttttttaaagaaaggattcttcccacctctacagggccaggtcttgttttcgaagccggacttcaatttttgagagggattaatgacagcaagtccctaacattccagggaaatccttactattcccacctctccaaagactccaaaccatgttcgtatgcactgctgttacctcttgcaatctgcattctctcagcagtcagccatgttcctagaacatctgaaacccctaaacctcccagcttactctcaggtcccatgttgcagcaggccacgtggggagtccttccagaagctctccccctcctcagcttctctccagaccctgcctccagtgcccattcttgctcttcctaacacctcttctgagggctgctaccaccctgccctggtcctcaccctactttacctgtgggaactcattcactttcattacatgtcctctccatacccaagatggactcagcatcctcatacacttttttgtgttgtttttttgagacagggtattattatgtagctttggctgtcctggaactcactctgtagaccaggctgagctcaaactcagtgctggaattaaaggtatgcaccactactgcccgggtaatgctttaacttttaaatatgtaggtgtgtgtgtgtgtgtgtgtgtgtgtgtgtgtgtgtgtgtgtgtgtgtgtgtatgcgcaccacgtgtgtacaagtgttctcataggtcagaagatggcaccaagttcctcggagcaggatttagctgcccaatgtagatgctgggagctaaccttgggtcctctgaaagagcagtcagtgctcttaactgtctggccccttctgtgtgtctgtgtgtgttttttgtttgagccagggtttctctatatagctctggctgacctggaattctctatgtagaccaggctagcctcaaacttcacagatgcatctgcctgtctgccttttgagtgctgggacctaaagatgtgcaccgccacacctggctcttcggttagctatagcacagatgcagcttcatctacaactctccagaactaaagcagatggctggagtgtcagtcacatgagcctgtcctcgggataaacctgggccttttcaagcttccatttccctcagctgtagcacgagctgacacctctcagggcttcggatgagatttaaatgaaataataggtgaaaagaggtgacagatgtgtctgtcacagggcagaatcaaatatcagttatttaaaaattttatcgtccacatcattgctcaatgtttctcattcgaaaacctctagggaaaatgctgtcttctgatgcactcacaagagacgttttcctgtgacagaggggtgacagcttgaggcagtctctttcctcactttggctaagttttatactcaattgcagatctccatgctgacctgagggaggcagtgtggtctagggagagggttaggtgctgcagccccatggtctgaggtggagccatcttgggtaactctctaggccacctgagccttaagcctcttcattgtggtcagtaaaaatactgaggatgatgtctgtcatatgggcctggtgagagtgcacttactttcataaataaaaaaacaaaacaaacagaccacgtgagagttggtgatgagcagtccaggcatgggagtggcagggtcttgtgataccacgaagactgcctgccccagcttgttatcctcctgcctcaacctcccaaatattccaaacatgatttcatgtttgtagtgtattttggtcgttctcaagcattactctctctcaccccctcctacttgcaccaaaccttctttctgacaagtatcccctgccccctattttcatgacttttgtttctttgcgacccagtgagttgagttaggtttgcctgcatgagcctgggtgtggagttatttagtggggcatggacaacttaccagcagctacactgctaaagaaatgtttcctccccccaaaccataacttctcaggaaggggctgggcctgaaaagctcctcctccatccacgatggggagtttctgggcccccgcttgttcaggtaaccgcagatgctgagtccagagtgcaatggctaggccatgtctagaagacagcagtcctcccatcctccagctcttctggcccctcttccgcgatattccctgagccttgaaaccgatgtcccattaaatttttaaattttacgtgcatggatttttttctgccgacacggccgtctgtatattacacacatgtctggtatctgcaaagaccagggaggcattggatcctctgtaactggattactgatggttgtgagctgccacaagagtgctgggaatccaaccaagtcttccggaagagcagccagtgctcttaaccactgagccatctttcttagatattccgtctaagactgaatactcaacagcaacttaccctgcatgacagttaggagcctttgcatcaaccgcttcccactgtaagtagttgctcctctgaccaaggctgaaagcagtgctcatctgtgggtgtaagctaagtattcagaggacggtttgacagcatgtccacttagcaaatccacacaaggtttcaccataaggcctatgacctcctcagacatgggcttctgaccaccaggtttatagaaccagacatgaattcagtcttagggagtgggtctcaaatccaatcaggaagcagttgattacccttctaacagtcacgccactattgcacaaatgggcgcatctcgccaacatggcagtttacagggttcacatctgggtaagaacattgacttctctcccccacaggtctgctggcatcttccatactctgaatgctagccagtagggggacacttccagctcagctctaattttatttctctttgtcctgcaactgaactatgtggtgtctctttggcaatagggttttccctctagttctaatggacgaccaagagcaatagcaatagcctgtattgtctgagggcctctgggtaggagttctattttatttattttagtttttacgtcagtatgagggtgtcagatcccttggagttaaagatagttgtgagctgccatgtggctgctgggacttgaacccaggtcctctggaagggaagacagtgatcttaaccaccggggctatctctccagtccgtgaaagtcatgaattttttattttattttattctgagtaggatattccttgtataattattttcccgctttccttccacttgcattttatatttcaaattttgctttgcgtcagtttctttttatttacttaattttacactcgcgtgtgttcacctatgccatggagcatagaagtcagaagacaacttgcaggactgagttctaccatgtggaactccctatcatgtggagtcccggcaatctaagtcaggttttgtcccactgagccctcctaccactacagatggcacaaaacacaagggtctcatacaaacactggggtcagcaacaagccacctctaccccctgcactgtcttgatggcctttttattgatagggtctcattctgtagattaggctggcctcaaggcaatcaatcatgcctcagccatactcagctctttgtaactgtctcttaatttgttctactctcctcctggaagtacatcaaaagtgacaaaataatccccaaagagcagtcttctgggaaccagaaacaatgttacttgttttgtctttttttaaaaaatttaattagaaaagtgtttatatggagcttttgggtttggagctgcttgatattttagcatcactgctaaaacaagatgaaccgaggatggttcaataaaggctttttgttgggctgtatgttcgctctcacttatttactaggtgcacacagatgttgcaagacagtgcacagcaagtgacctcccaacacagcagccatctcgtgtggctgcagccaacattgcagtatgggaggagggtgtgaacaaaaagtcacatctgtttttagaggtgtgctaagtgagcacaggacgttataaggtgcaccctggaaaccctgcaggggtctgtgggagagagaaggggaagtgacaatcgggaaggttaagatctctttagtcagcaccaggaagaatgaggtccaggtagataaaacacagtgtggtcccttcagataacttcaagtgactcagtgtgctcagggaagaatggatgagagacctgttaaatcaggctggaatggaggtggcagcaaactgaagagcctgtggcctataaagtacctgagtgttatcttgaagatgagagggtgtggtgtggcaactggtgcatatggccacaaataaggaccccgggaaccacaatacaactccatgttgagtcactgtatcttaacactgaatgctatggatacaatctccacaagcaagcaccattttctgctactggattcagctagggtttgcatgaacacaggatctaagggaggtgggcaagggtaccaggatgggccctaatgacctttaaagttgctagcaaagttcctgacactaaagcaagcccagtagctaaactggtgctgtgggctgggatctgtggctggggagctgccctgggcagcaaatgggttaacactcaaatgacttttatatatgaattaatgtgcagggttaggagccaaaatctgttccattaatttttccatccattccaggagcagttaggtacacacagtaaagtttattttggtgcatggcatacttcactccattaaaaataaattaatcagcaaattcctgcctggctcgcttctggtttatgtaaatagtgcccagatgtaatgagttacaaggtgttattatctcgcactcacagaggacgcttcactccagagccccgcttgcaaccaaagcatcgcaaataaagcaagagaaggcggcttgatttgtaatgttttcacagaagtggcgtctacctcacggtatagagtttctttatatgactcattttataacaagttcaatgaagaaagctggatgggggagggagggcaagactgttcccaccccctttcctcaatttcagaaaaaccttccaagagatgacccaaactctctgagaggaagaacaggccccttaagagctcagaccaggtgtcccttacagcttatgcttcagaagctgaggacagggtagaaattgggctggggctggaatggtactcacaggccaggaagactttctcatgtaaaggatgtcactgtgggtgacaaagggacttctattctccagacctctttctacatgacttaggatgtgacaagccccttggtcctcagagacctcctgggtcccagagaatgtgcctggtggactgcgatttgcccagacagtggctcctctgtgaactggagacaggagcagcaagtagcagggagcctctgacctctctctgcctctaactgagctggagttaattcttgagcctggatcgtccaccgtctcacctatgtttctgttcttttttagtttgtttgtttttttgagacaggaaggtttctctgtatagccttggctgtcctggcacttgctctgtagaccaggctggcctcgaactcagagatccccttgcctctgtctcccaagcgctgggattaaagacgtgccacaaggaccggctttacctaggtttctaaaagaccctggaacaaagaagaaccatggcagaaatacatcttttttttaatggctacttcaaccccatggctcatagctgggggacagtatatggttatccatcttgacacattagaaacttctcctaggcacagggggccctgggtgaggggcccctttctaacctacccatcccttcctcagcctttgggaaaagctctcagtcacatgtgctgctggagggacttggaaagtgtgcttggggcttctcttgagggagggaacatgtcgggagagcgagatgacctcccggtagtacccccactggatcagactcctgggatcacaagaagaaactcaacacaaaggacccgagtattcaacaggtgctgttcaaaagtcagttcaggccaccttcttcagagtcctagataaacaggcacttcttccatgggggttcctcatagccagccagccagccaactgagcagtcagtcgggccagtctctcaaagaccctcatcattgtaagtaggagtacgaggcttcaagatgctctgtggattcttttccaccagagggcgccatctcacttctcctgtcagaagcagatcctcaccattcatggagtccaggtattgcatctacaagtagagagagcagggggacagagctgtatgtgagggctgcaaagcttccccaaggagtggctggaagggaacacgggtggtggtggtaacctgactgtccagctctaagattatggcattaagggtatttggagaaataattacctaggtcagtggttcttaacctgtggggtgaacagccctttcacaggggtcgtatatcaaatatcctgcatatcagatattttacattacaattcttaacagtaggagaattagagttatgaagtagcaatgaaataattttatggggatctccacaacacgaggaactgtactaaagggtggcagcattagagtgttaggaaggttttttttgtttttttttgttgttgtttttttgtttttgtttttcgagacagggcttctctgtagctttggaggctgtcctggaacttgctcctgtagaccaggctggtctcaaactcacagaggtctgcctgcctctgcctcctgagtgccgggactaaaggcgtgcaccaccaacgctcagtgcattcggaaggttgagaaccagtgacctaggaaattgcactgacgatgttgtagggaattccctatcacatatccccactccacccattcaatccctaggagggacatttaccctccgccacacactcataacaaagttcttacaggccaagaagttagaacagatgatttccagaagtcatcctgtctacatcttgccttcgatggtccccttgtctgagagcagccggaaatgtgtatcttaccgggcacaggggagagtaaacagcacagtgcatgccaaaccctggcacaccaactgcttttctaacgtgtttgactccactatccttcagtgggtcctgacactgcccagaggccctagtttgccccacccgactgggcaggctccttatggggagaaggaagactggggcttcaccttaggccttggattgtctcctcttccaagagctcactgctcctgtttcattttcagactgcctcttgagctcaggcccagcctctgacccgagaggctcagctttcctgggtccacagttcaaatgaaccacagtccacgcctctttctagcttccccactcctaccccgaatgccaccattttgcctacctcctgggttgttgattttaactgcagattgattaccaaatagtaaccaatacaatgtgtagtaccagagactgctcaaggcccggcttcctgggctgccctgacacactgggtcagagcatgcctttctctggcttccccagcaccctcctgaccctggaccacacacactagactggccagttcaccccagggctgcttgtgggcctgcatggctccagggcaggactgagtctcgaagatcagcccagggctggcactgcaggtgctctaaggcatggcagaactgggtccccatcaaagcttcttactctcttagggctccaccattgcccatttctagtggggtcaaatgagacttctcacaggggcatttgttaaggcaaacccttctttctgagcccctggagaggtcctggctatgccttgtcatggcctctggcacaagcccaccaggacagatggaaaaattgggtgggtctctaaaaaaagtgtttactttgccaattttgactcctgtctaagggtgaggctctctagccacagtgccttctccctggctctggcagatccgaagagcagtcaaatggcaatcggcttctggggttccctacgctccagctaccatcagcctcaacatgccagctttacatcaggcaactagctggtcctattagccctgtctgctccagagctgtgatctggccttccctttcctgcttgttggacgctagcaaggccatggaggtgaactcatggcacgatgccccttcagccccaggggccaagtccatgaagcaaaggtgtgactcacaacagctcatgctggtgagctgtctgcagctgctgtggtctccagtggttaaatgattcacccagcctgggttttgaggccagtcgtgcagggtgaaccactgggagaccccagaaaagcctccatgtcctgcctcaggatgagtgaatccattcatgcagacggaatgaatttcctgtccacgcaggatctagggcaggagatcaggagttaattctgcctggtgctcaaacagtcctcccaaggagctcatcctggaagctttagggtcaggagccttcagagccagaggggcaaggacctgatattccaaccctgcttgacagcaaagagcagccagtggggagaatttgacgtgtctgtcaggggctgcctgaagcctggctctgctagcagtaaggagcacaggaatcaatagccacaaaatgggcacaaaatgggcacagtgggtgtcactatgtctcattccaaatcttccagaactgagggtgtagtaattagcacagcacccagcaccagcaggtagtgaaacagcaaatgaataccacggctttctgaaagcacaaggctctctctttcctctcattccccacccctggcatcctcagcctcgttcacagctggacacgaaacgtgctcattcttcattattgttttgtttgagacagggtttctctgtgtagccctggctatcctagaactctctctgtagaccaggttggccttgaactcacagaaacctgtttgcttttgcctctgcttcccaagccctgggattaaaggcatgcaccactatgcctggccaaagatgctcattcttaaactaggtctggtggctcacagatgaaggcaggaagatcagaaatccaaggtcagtctgggctacaatgaaactgagagaaggggggggagacagagagagagggagaggagggatggaaagaggaagaaggaagaaggatgggagaagggagaaagaaggaagggagggagggagggagggagggagggaggatgctcagccttcatcatgggtgtgttgttgatgtggctgggtcagaatcccttaaactagctcctggtcagtcagcctcttatgacctaccaagatgcttgcactagcaccatgcactcaggaggactcaactgccaccaggtgtgagcagggagcgggtgctaacctgtttcctcacatactccaccagcaattcaagctgccgagggtcttcacatttctggttgaagaaggttctccagagggcagcagccagtccacgatcatcagaaaggatcccctagaacacacaacaagacgtgtcttgcagagccatgatattaacactgggatatttgaacaggagatcaaagaatggattcagatggagagagagggtaatgggcgagcttaagaacatctgacttttttttttttttttaaggggtgggtgggtgtggtgacagggtttcactgtgtagccctggctggcctgaaactcggaccaggctggcctcacaaagctgcctctgcctccagtgcttcttatttgtttaaaagtaaattttatttttattttatgtatatgagggtttggcctgcatgagtaccacttgagtgcctgtttcctgtggaggtctgaaaagggcatcagatcttctggaactggagttacaaatgattgtgagccatcatgtgggtgctagaaattaaacccaggttctctggaagagcacccagtgctcctaatcaccaagccatttctccatcccctcaacccttcttttatacagaaggccatgggactctgagagtcctggcactggctgaggtaatgcaaagctggcactcatgcctgttgcaccctcccaggtatagtccattctcctctacccattgtgcctggccgaggcaatgaatgtctgcaaggcccacccagcaaaggagtgtagtagccatacttctgctgctgttcacaaatctgtgtttgcctgggcatgggggtgggtgtgaactgctcatacttgtctggtccaaggtcacacatctgcaaggtagctggctctttgggaaagggaactgagtaccctgccttcactgtcacccgtctggccatgactggcttggactctgaagcaagggacaggctgtttagtaggttttccatgggccacacggggctgcctagggccatgctcagagcctgtctgtgtgtctgatattgcctctcctggcactgggaactcttgtttggaagcccggatattatagaggccaattacagccattttctagcccagacctctagggcagggaggatgaaggcaaatgaagggaaaggccctaagaagtgcatctgccttggtgccaaagtaggacatggaactgaagtgttgccttgaactcagacgactggcacaatggttatggctaaacccaagtctcagggctctaaaatgggtggggtggtgaatgcctctcaccccagggcttcagcggcagaggtaaaagaaaatacttgctctacctacagcatccttgaattacaaagatgaggtaatgtggcctgggggtgtggctcagcggtggagtgcttggttagtatcttcaaagccctggaatcaattcctagcaccaccacacaaaaagtaaagtcttttaaagagaattacatgtattgattttgcatggatgtgggtatgggtgtacacatgccagagtgcatgtgaaggtcagaggacaacttgcaatgtttggttctctgcttttaccatgtggatccctgggatccagcctggcccataaggctttgtggtaactgccttaactgaacgagctctctccagaacagcttttttatttttatgacagagtctcatgtacccaaaactgtcctcaaactctctatgtagccaagggagcccttgaactcccgaccctctgcctatacttcccaagcactagaattacaggcatgtgccattgtgccagtctgcaaagccattttgaaaagtgaaatatgttggatgcaatatacaaaagcattgctttcactgggagttagtatagtcgaggcaacagtgggatatgggagtcaaaccacctaagttcagtgccagctccgtcactttatggtagtgtggccttcgagaagacttagcccctctggagcctcagtttctcattcattagcagagcctgattaattcctaccccacagagacgatgtccacaaaaggctcgttacctagtaagggttacaaagacacagggacatttagtccatgttatacagtggtctgtggcatataagagggctgactacaggtcagctatcaaaaaggttcaacctacccatgggggggtaacagataggtggaaaagcacttcacctgctcgagatgccttctgctaaataacccccacagtttcacagcggaagactgtcctggtgtgcgatggctgagctgggaaatccgcttcttctagcagatggcaacaacaaccaaggacaagctcaggcacatcatcctcccgcaagctatttgctaacacaacagcccgcctgtgtgtgaagtgccctgggcacaggcgggccgctgttggcaggaacctacttatgtgatatgggaaggagtgggtgggagtggcacaggagcttggagaaagaatagagcccacaaagagagaagccggggagtcatgacctgtgcagtcagggatccctggagctggggagacggctgagacagggcgaatccactcacaggggtcctgagaagttagagggcaaagggggactcggaggtgttagccctgctaagaacctgttccagattaccaggtctctttgccagctagtgtctaatgactacctgcaccacaccactcagcacaggtgttattacccccacatgaaagataagtaccgaggctcagaggttagcgaggtaattggtgttgagaggaacctgcctgtactgctgaggtcaggggatggtagctgcctagcgtcacacagccctggcatacagtaccagtgtgctgaaaatggcagactccaacgccaaacccagccgcagtcttctttccatcagactgctagtagctcagtgaacacaaatgggagactattcaagtatgcaaatgtgaacgtcaagaaacagaagaggagaaaggtaccaagcattagggtgcagggccaattcctcataatctaggaatcgtttgcctcatggcataaaagaaggcgttctttaggaaattagcgcgtccaggtctagtgcggtagacaggaagctgtgtccaggtctagtgtggtagacaggaagctgtgtccaggtctagtgtggtagacaggaagctgtgtccaggtctagtgtggtagacaggaagctgtggcactgtcccggagtggcagctaccacctgcgcttcgcaccattctaagatgaacacagagtcacatcggctgagctcagctctcagggggcttgcaatccaggacgcatgaggcaacatagcaaagtcttggacagtgaacaaatgctaaggcccttggtgagaccacaatccactggtgcctctgcctcctcattcttcagcctttactttagaagcggtccttggagagctcctcctggtccacactgtatcttccactgttattctctaccggtgccctctaagcatttttctgcttatttagtagctacttgtgtgccacctgtctcagtaacttcaatgggagagagactgaaactatgtcagtttgagtcaccaacacaatcctcatctatcacacatgataaacatgctaaaaaccattgttaaatggatactgaaatgcagagtaaaaacacaagcgatctagtgaggtcaggaaagaagtttcgaagaagtgacctagggagatcagccaggcggtggtggcgcacgcctttaatcccagcacttgagaggcagagacaggaggatctctgagttctaggccaacctggtctccagagtgagtttcagaacatccagggatacactgagaaaccttgtctcaaaaaacaaacagaaaggaaggaaggaaggaaggaaggaaggaaggaaggaaggaaggaaggaaggaaggaaggaaggaaggaagttaggaaggaaggaaggaaggaagcaaagctgttttggacttacacatctaaaccacctgggaactttttttgttattttttatttgattttgtttcatgtgcattgatgttttgtctgtgtgaaggtgtcgtttcccctggaactggaattacagacagttgtgagctgctatgtgggtgctgggaattgaacctgggtcctctggaagggcagtcagtactcttaactgctgagccgtctttccagccccttgagatcttttgcagctatctactcacaacagttaagtcagtacctttgggtgataggttcctgacactgaaatttctagaaagtatcccaggtaatcagtgtattttccaggctttcctgttcatgtcacctgggtgcttgctgaagcaccgagtggctcctactggatcaaagccttcaaaggggcatagggaacacatttaacgtgtctcctgggtgcagactatgagaggctcccatgcacatacagacagcaacaggtaaactggtaaactgccagtgggtggggggggggggggagaaaagaaaggggagaggcaggtaagtttgaaggaaaaagtggtggggggggaattgtaggagagggaatgggggtggatttaatcaaaacacatgatatacatgcatgaaattctcaaacaatgcaaaaggggaataaaaaagctagaaacatagctcagttggcagaggcttgcctagaaaggataaaaccctgggttcaatccctaacgtgaataaattgacgagataagaagccagatgagattacaggcatgtgccaccatgccgtttcatcagtccagagaatcaaacccagggcttcatgaagtaagtgacctaccaactgggctgcaccccagtgttactctgtacacttcttccccacatcactgcaggtccagcactgtgttagacatcagaaacaattgggcactgtcacttcccaaaagaaagccacacccagccaggtgacagacttaatgctggttaagtgctgtaagcacctgggcaggtggaatgagctaagcctgggaaagttggggactctttcccaggaggtggtgcttgcataaagtcaggagttaaccacatttatcaagagaaaaatgaggtatgatgaatggttcgagtatgtatacaggtgttcattacaccatctttttaattttctacatgcttgaaatttccataataaagttggagggctgggaaatgacacagatacaacatggatgaacctagagacacgctataagccagtaacagatgagcaaacactgtaagagtctgctcatagagacagaaagtaaaacagtggttgccagggtctgggaggaggaggaagtggagaactggcattcaatgggcagactttcagttcgagactgtggctgctcagcaagcatagctttgtgcatgaggcactgcagacaagcctgcaggtgtaactcatttgcatagagctgaggaactgctatctatgtacttgtgacacctggagggagacttgatgaactatgatgacttctcctttggggctggagaagaactaggtctttatttgtatttcaagcaggtacatacagttttatgaatttttaaaatgagtatatgcagctaggtgtagtgacggcacatgcttttaatcccagcactctggaggcagaggcaggcagacctctgagtttgaggccagcctgtggtctacagagagagttccagaacacccgggactacatagagaaacgttaaatacaaaaataaaaaaagagcatgtcaggggctggagagatggcttagcagtttagagcatttgtttctctaaacaaatggcaaaggaactggattcaattcccagatttcacatgatggctcacaaccaacctaagtccagttccacaggatccattgcccccttctgacctctataggcaccaggcactcatgggtcatcatacatgttggcaaaaagttcatacacataaatgaatatgtgctgtcttaaaatgaaaactaaacacagtatacattttgtcccacatatcatgttgttttatgtatgagtatcaagcattccctggcaagagccagggctgtggcagtctgatttgacttagtgcccccatccagcactgagcaggcaggctctcaatgctaattcattgaatgtttaacaaaaacatataatgctctctttcccttgcactcgatgaaggtgaagaaataaatactaagaaaaaaggacaagtagagggactggagagatggctcagtggttaagagcactggttgctcttccagaggatccgggttcaatccccagcacccacatggcagctcacaactgtctgtaactccagttccaggggacctgacacccatggcaaaacaccaatgcatataaaattgtaaaaattaattaatttaaaaaatggcaaacagagaatatggtcctcaaagccttcacatattctcctcaaaggctggagagatggctcgacggttatgagcgcctgctgctcttacagaggtcacaagtgtggtacccagcacacaagccagtgacttgaaactgcctgtaacttcagatccaggactttcttctggcctctgcaggcacaggtgcccccccccacacacacacacatgcatgcacacacacacactctgagccttttctgggactgggtgtggttgtataccactttggttcccagtacccatgttgagtggttcacaacttaaagcctttaactccaactccaggggattgatgcccttttctggcccacacaggcattgacatgctccttcacacacatgtggcagacacgcacacaaattaaaaaaaaaaaaaaaaaactttaaaaaggaaggaagaggagttggaaggctggtgggcctttgttggggaggccactgtggcctaaggcttggcaaatgatcttacctcatcatatcccaagattgacgcatagaaactgtttgtcatgtaggccatgttcttctttaggatataggaattaacctacaaaaacaaaagtatgatggtaaggaaaagcatgatgtctcttagctgtcataggctgttgaaacaaagagaaaggaactcagtttaaactgccagtccatttccaagccccttggctgtcaggattttccacaacaaaactgccacttctttcagattttgattcaaaactacattcatttaatgactgaaccttcaactgaatgtcagttttgtgttagtattgatcaacacaaagtttcagaaacatggtctaattacaggaccacacagcctagcataggaaaacagacatcaaacaattactcacaggtgtggtagctcactcctgcaatccctagtgtgtgtgtgtgtgtgtgtgtgtgtaaagttaaagctcatacagcctgggctacatgagaccatgtctcacaaacaacaaaagggacactgagatggtttagcaggcaaaagtgcttgctatcaagtctgacaactggagttcaatccccaggacccacatgatggaggagagaagtgacacctacaagttgttctctgacctccacatacagacacacacacacacacacacacacacacacacacacacacacacacacacgtaaatgcaatttaaatgattatcttactgtgtgtgtgtgtgtgtgtgtatgtgtgtgtgtgtgtaatacctgaatgaagttacctcaaggaggaaggtttcattttggctctcagttctgagagaacacagtccattgagcaatgggaaatgtggctgtaggcaaatggcagggaagtgaggctgccagttcacatcttggtgaatcaggaagcagaaagcttggaccagaggtgaggccccactatgttcctcaaagcctgtcccctgcaatatacttcctccaggtagctgccacttcctaagggttccacacctttctaacaagtccatcacctagaaactaagtgccttgacacatgagcctgtaggggggcagtttacgttcaaatcgtaacatgataaatcaaagactgagtgacttctatcctgggattcctaactgtctctggaggtcggaaaaggcaaaagggtttgggtttagactcaagccctagctgtggtatatattttgggtgtggtcttgagcaagccaacctctctgaggctattttgtcttttaaatgccctgcacacaagaactgttttcaagagcacagaagttcgtttgcattcattcattaagttaacaacataccctggaagtcttggtaaacgtcagtgaactcgacaaacacaaggaactgtgagtaagacctggtttgtttatacaaaactaaaactaaaagcagttccagagctttacagttgtggacaatgttcaacagtgaagagagaactgtcaaggtcgaggctggaaagtgtgagattggtggtggctgggcgtgtaagccatggcctttcctacccagcttcaagccaggccacagtagccactgctcctttgtgctctcagggctctgtctgcatttctccccctaggtacacaatatggttgcagttgcttatatacctgcctttcccaccagtctgtgagcaactcaagcttggctcacaggaaacaggactgaatcattttggcacccaaacacctgggccaggacagggactaagaagggcatcctgataatgaatccctgcaaggtcaccacccagggctttggatacactcagagctgagcactttcctagcatatgtgaggccctgggttcagcaccccaaacgaacaaacaaaagcgagggctactcagagcatgctctatccaatgacacaattattttgtctcggttttgctgaaaagataccttccatgtttctgaaattccagaaatatatactactgtatttctttctactgcttcatctaatgtgctgtggtgagagtcagaataggcaagagttaagggttcctaccgtcgctcaaggacaagaggtcagccagcccttttaatacatcgggctcttccttacttctgtactggttgttcccctaaacgtgcaagatgaccagagccaaaaagcacgtcagggcatccaacacaaggcaaggcatcattcctaggaaaacatttaccaagcccgctcggtcagcagttagcttacacactgcatcatgccaactggctttgaagtggcaaaggccttcagggatcacctggcccactgaccccaaggaaatgaacggtgaagcgaggctcaaacatggaaagacacagatccaaagtcacatatcaagttaccatcagagtatgagtagaggggatcaaatgagtccatttcaccatctgacgggtatttccaaagatcccccaaatattattctgcaaagcttggttcctgctttccagagaggcccaagtagggacaaatgcaccttctcctggagaagatggctggttgcctggggagagccaggtataggattggagctcagtgttagccaggttctactccagtgtgcccctgtcacttctacagagagaagcaagctgccacagctaggaatggctttctcatatcactacccaggctagattagatcatgaaaaggtccctttctggaagacagtgcaagcttgatcactgcaacacatgatctgcaggcagcagatgaaggaagtgacaccaacctcactgggcccttgatgctggagtttccctctgctgaacccccattctactccactccttcacttaagcatttgtctgctggtgtgctgggtccccatctccccggtgctggatcatctataggaagcgtgttgcttatgaatactcagatcccccagcagaagatggtgttgggctgtttgctcattaaaatcttatcctgtccataatgctttgctttttataaaaacccatacatactgagccatcacatgggaaaggctccctttatatcagttactcatattttcccatttatttaagctattaaaattcatgcagatattttataagccatcaggattcgatgactgctattactgaatgtttaataataaactaaacagaagaaatcagagggttaaatgatgactgcaattcctgtaatgacttaattaaatttttattgagtacataaactatgatgtcacttctagccaaccatggctctgctttcgcagcatgtcacagggtgggagcactcaataggaggctaggctaaatgagcagcaggtctctgctgaaatgggggagggagcaaggctcatgtaacacactcaataaattatccgttcatttttaaacaaagtccatgagttataatatatttgccatgcactttttatgacataataaaaatgttaccttaaggattacttaacacatactacaaatgttatagcagaggcaggcacaaggggcaaagaaaacaaacatgaacaggccagggacgggtcctggagtttatgtcccgggggaacagcacagtgtattaaaaggggaatgcaaaaaacagggggtgcaagtgttcagggttactaatcagcagattaatgaatgagacagccaacagggagcacaagcaagaagggatctcacaaggcacatgtttaattaatgggagtattctcagggagggattcaagctttaaagagatgccagttcacttgaggctgcccctgtctccttctcactgctgcggcccttagatgcctgtgcttaacagagaactggactatggtatagagactgaaggagacctcggtttagcctacgagcactggcgaaggggcttcaggattttccctaggtcatttctctgacctcactcccttctgtccccccacgttcctattaggccttggtcagagtcaactctgccatttccacagctggactgtgctctcttgttcttagccacactaataggagtccttgtctttactaacggaagggatgctggtcccttctcatcttcaaagatccagcctccaaaatagttattcccagcctacaggtatcatgaatggttcaaagccagaaacaggtcacataattggctattgtcacatgctagcagctttgtgcatatttgctctattagtccttcctaatgaactctgagaggggaccattttacctccactttttaaattccagttttgctcatggagatctctatatttaaaatctaaccagtctaataatgaatgaaaagcaagatacatggttggcagtgatacccacaaaaccagcagccttaactcctgaatggtcacataacagacatttccttagggtttttaaaaagcaaaccaggcaggaaaagatgccaggcatggcggcacatgccttgtaatcccagcatttgggaggcagacatatcacaagttcaaggtcagctttagcctacaaaaggagtttgaggccagcctaagctatgtctcaaaatcaaacaaacaaatctaaacagatgactgtccttgcaaattaccatcacttatctagttgacaggcattcgaatacagttgttataattgctttggaaagcagctgatgagctacagtaagatcttgagaagatcaaatgtcagcttactattcttaaggagacacacacacacacacacacacacacacacacacacacacaccataccccaggctggggcccagtacttaaggaaaagctgagtgcagctgagcacagcagctgagcacatactgatcccgtctttcctggttgcagatgcagactgctcatctggctctggatgccttacctctctcaccttcttcactgaagtgcttctgttgggtattaccacagtaaaaaatgaggaaagcaaccaatacactcccaaacccagaaatgtggcaagataaccataattagacatatttaaaaaactacatacaaagttaaaaatgtattaatagaggttagagagacggctcagctgctaagagcactgttggttcttttggaggacctgggtttgggtcccagctcatagctgttaacaccaatcccaggggatacaatgctctctttttgtactccataggcaccaggagtgcccatatacacatgtaggcaaaatacccaaacacacaaaataatattaaaataataattataaaagaaaaaagttttattaccaggtaaaaatacacttttattgctttttttttttaaacttaccatgcttgaaaatgaatttcatgggaaaaccggagaaatatcagtgaagaacagatacagttacaaacactaaaactaataattggctaggacactcactgttatatgaccaagagaatcattcagaagttatttcatagggtgcttccatcatcaaactcaaaggactcaaaggaccaagagatttatttattctgatcctatctgagatgatgttctctccccctctaccttcccttaggtcaaggatctactttgctttcaaagtaagttgaaatactgcagatcctggaaccctggcccctcttcagagatgggcacatagcccaagctgatttatcaaattcttgtttctaagaacaaaaataaaactctgctacagttcagtgaccctaaagttgtataagctcctgtagctaaggtcccttggctacacagagtctttcctttccagggcctgttgttagaacaccctttccactttggaagcctcagttatcttccagggaatttgtttaaatgtgccaaggttggcgctctgttgctcacaatctgtaccatcattaatcaactcattaaaaccagatgactgggctgggtggtagtacacacctttaatcccagtacttgggaggcagaggcagggggatctatctctgtgagttcaaggccagcttggtctacaaagggagttttaggacaatctggaactcaaaagtgatacacagagaaacgctgtctcaaaaaacaaaaccaaaaaccgaaccaaaccaaaccaaaacaagaaaacaaacaaaaaacaaaaacaagcaaaaatgccccatatgatggaacatctgttgaacgtttactaagtaccagaggctgtaataaaaattttcaatgagttatctcttcaatcattagaataatcccaaagtcatttagaagaggcgtcacctcttgtttccggggagcttttcgagtcttccacacttgctgcttttccttctcctgggtctttgcttccaccaggaacactcactgcactatttaatgatttgtttataggccaagtccaacacaccgcattagacagtatgtcccttgaaggcaaagatgtgctgcccagcacaaggcagcttaaccagctagtgttttgccctaaacatgtcttgaagtagtggtttcatgcaccttcccacatttcaagaaagctccctgagaacaagagtacatacagctgctgctgtccaagtgggctgcaagcacagcgccatcaagatgaggaaacccggcttctgtcctcatgtggcccatgaaatcccagcccccctcaaacagcatgttccctgaaacaagacaaagggcatctcctccatcactagcacttgctggagctgtaccaggaactctctacagaaacccaatgtcacagagatacctgaggtcacagcagagcttctggctgtggagaaggtctctcacaactgtcagcctggaatcctgcaggtgtgttatcagcctttcacctccacctgctcttcaatgaggagagctatgaaaacagtgcaaagcttcccaagtagtgcttgctcatccttccaagtttaagagagtttaacgctagcaagtgttagtgcagacatgtcccaggcagtctttgctgttctactgtgaaatacgaaatttacaaacggaaaacagcttattggggatcaccattccccagtaatcatggtagaatcaataagcaacacaacgacctgaagtacaagcaacaggtagtttatgcactcctataaggatggctggaattaagtagggaccctcacaagagaatgtgaattggtgcaaccattgtggagaagcatttgacagctcctctacaggttcgacattgagctacagtgtgacccggcaagcatatctacagaaggagtgcaagcatggactggatacacttaaactaccatgtaaaatatggcaatggtgtggggcctgagggctccggggaagaggtgtcagccatcatatcagagtgtgcacaggttgtgttcagacagaaagggtggcatgtgcaaagccatggagaggagaacaaagtatagtattttcagagcaaagtagaccaggttggcctcaaactcagtgatcctcctgtctgcctcttgagggctgggctttgtattgttgttgttttgttttttgagacagggtttctctgtgtaactgtggctgtcctggagctcactctgcagaccaggctggcctcgaactcacagagattcacctgcctctgcctcctgagtgctgggattaaaggtgtgtgtcaccaccgcccagtgaaggctgggtttacaggcatgtaccacatgcagcttcagagcaggtttgtaacaaacaaacaactacagtgggtgctgagatgtaaaggcacttgccaccaagtccaatgacctgtgttcaatccccatggtaaaaggagaaaaccaactctcatgagctggcatctgactttcacatgtgccacaaggcatgtggtgtgtgtgtgtgtgtgtgtgtgtgtgtgtgtgtgtgtatgctcatgtgtgaaaaccaaaacctcatagtgggcagaagcagaaaggcaaacagtctttattgtctgtaaatggccccaaatgccacacaaagacaggaagctgcatggacacaagtaatttctagcagtgtggaccacagagttgggcagaggaccagaggcagaaatcacaggggatgttgtgtaataaatagtccaggtgagagtgaataaggaactcgctcaatggaagcactgaagggcagtgtacagctgggtacataagcctatagtctgagcacttgggaggcagagacaggagtatctgaaagtcaaagttagcttccattaaacaatgagttcaaggctagcttgggctacatgagaccctgcctcaaagggcgaggtagtgcaggaccaatgggatcaggttatcgatcaatgaaggagcaagggtgaggccataacctgcacataatcagacctcgctgaagaaaaagcaaagagaaaagaaagatggaaagcaaccaccaaatacagccacacactggtgactttccaaccctggcagcactaagtgtagacaaccagtcttgcagggttctagcaatcactgtgcccttaatgtcttctgtgctgtggtaatggaaaatcttacttggataagatgtaatgtgagcaagatgtgtacttagcttgagcccagcgggcgtctccaggggagcagaggtacagcacaggagggctttaggagcctgtgcttcctttccagtcatttgttcactgcatgtccgtagaagtcattcctctggtcctctgtattcaacctgtgaccacgaaacctgatgactgtcagtgagaagatgctgacacacatgggtttctagagacattcacagactcctaattgtaccctgggcctcatgatgacatttatgagtacagaaagctataggcacaactttgctttcttaatgattttctattaaacatagacagggtacagtgaaaaactataaagtgcttgctccctatcacaattaggggattcaaatacacaatgtggtctgataggtaaaaacagataacaactcagtgaactcttaactaagacaaacaaggtaaaggatggtggggctgaaacaatgtacagggacctgaggactatcccagttcttgtcccactcagcaatcctcaaatagatccatgacactgcacagcaatgtttgcttaggagccaccatccagctccttgtcatacatactaagagggttctagctacgtcacccgacagccctgacttcctcttcaggtagtgaagtggggatgtccccagtgaacagagttacacaatctaactggtgactccacctgggcctagactaaagtctgcagactaaacagtaaagcagacatttccattggccacaggatgtttctcttttaccactgtgtccttattgcatactattgggagttaaaattttccaagtgaccaacccaatggtaatctgagaaagaggtcatttcccagtgcagaaatgaggaaacaaaggctcagacagctcgagtgacttgtccaattatcatagcccaacttgtttgtgagtgacaaggtctcattgtattgttcaagaactcctgggctcaggggatgtttttgcctgagcctcttctattttggcacattgttcttttaaggctcagagagacctgccattcagtaaatggcttatagaatcctatagaagtaccctggaggaggctgaactaagtgtgcaaataagatcactcccacccacagtgactgaggaacaaactttgtttggatgtccttaaaatggagctgacacctggtcttgtgaactctgagtggctctgtctctaaagagtattgtcttctttttaaaattatatcttttatgtttattgtatgaatattttgcctgcatgtatgtctgttggccatgtgtgtacatagctcctatggaggtcaaaagaaggcctcagatcccctgggacagaagttatagtgactgtgagccgctgtatgggtgctgggaatcaaacccaggtcctctgcaaaggtagccaatgctcttgacctcagagccatctctccagcactttttttttttccttttcctttttaataagcaaaatgttctttaaatggtattttatccaaaggaaagagaataccttggaaagaatgccatgtcctgtaaggacatctctttgatggtctgtattcaagacaactattaaattgccctgttatcaaagcaaagtttaagttccagtagccattcccccaccctgtcagtctggaaataaaaatcactcccagactcagttttgcatcaaaaccatgcctaactgccttttctcatattaacctgtgaggggacatgttcatcaataattaataaaataattatctatttcccagcgctgcttcaaggtcctcatatgtgacagatacctcacaatactatagtttgggacaagaggctgggtaccactgtcatttctttttataggtaggaaactgaagcacagagactatgtaccttggccatatggctggggcagcctgtgaacacatcaagcctggcttggccaccccactcttaaccactctgtgatatgctcacaaaggaagtttcaaactcacctaagggggagagtttgcatttctcatcccacccttaaagcccgccccatcctatctccattcactcattctatctacactaggacagcttctctaggaagcgtgccacaaaacaaaacagcaggtgagctcctatctctcttgtttatctatttagtttggaactgaaaccaggaagacagccatttatcttccaggcactaaactacttgtaagccctgtaaggtcacttttccctgaaatactcttagccaatagtatttagaggttagtgcatggtaaggaacaaacaaaggtgttccttcaataatgaatgaaacaattttttttgggggggggtctttttgagcagggtctcatatagcacaggctgttctgaaactcaacagcagtggagaatgacttggaattactgatcatcttgcctccattttgcaggggatggggttacaggcatttgtcatagtacccagctgtatgggagaaaagctacacaagttaataactatgtaggttgggggtgagggtaacaacaagtaagagcactgactactatagaaggcaatgtcaggtgtcttccataactgctctttaccttttttgttttttgagacaaggtctcttactggcttggccatactggctggccagaaaacctcagggaccctggctcttccttcctagggtcaggattgaagagacttccctaggtgcccagctttttatatggatgcagggatttaaactggggtccttacaattcccagcccgatcgaattcttcatggtggtgtagggcgtctggaacagagaaggaaggagtgtaggaagccaaggcccccaaaagtaccacaggcccctacatgtatcaagctagatgagacaggataaggccagccctcctttctctagagagaggcttcctctggcaagcaattcacttggggactaaagcactgcagacaataaacagctccagtttctaaaagagaaagctgtgcatatctactctagatgccaaagacaatggcttatttgaatcccaagaaccttagcaaagggcactggaccgggttgaaaaagagaggagtgggggcatacagaaagccactgaatacccagggggaatcatcttttatcccctgccccagccactcacaagcccatggcctagaaaaggagcgacagatagtttacaccttttattattctgatagaaatgtctctcccgggagcaggcaggggtcaaaagtccaacaccaaaactatatatctttataagtcatgagcaaaaaagcattacagcagttattaaaaaaaaaaaaagccacagtgaccagccgagcaggaggtgttagaaaactcactccaaataatttattcaccgagaaccacaaagggctttcccaagaacagcaaaaacaccattaatttccctaggaccctccctttcaaagggctccaaacaccacacatttcatattaaattgtcctcaaagacttcaaaataagggttactatttccctaagtacagatgtagaaactaaagcattcatgcccaccacactctgaccaggccatgctaaagagtgagcctgcttgtgtccgatccaggcctcctgatagagggttacaaagaccaggagtaccacctccatcccccacaaagaccaaaaaaaaaaaaaaaaaaaaaaaaaaaaaaaaaaaaaaaaaaaaaaaaagaaaaaaaaaggatctctaccctccagaacaccagagtccagtagtacaaggcagatgcacacatattccacttacgtttatgcgaactgctattggaaaggcccatacacagcctgagagctgccatttactggggcctgatatgttcctaggagtgagcattgtttaagtcacccaacagtatgtgactaatagaaagaatgaaggcaaaaagaggtagagatttgccaagggtcctaaggccacctgagccagagacatgactagaacccagatccgtctatctggttgtggaaggtcctggagctgcaaggtgactgcttgggaaatgaaaccggcctctgggcttttcagcactgaatgcctacatggtagagacagacagcaggcacacacacaacacacagacagctgcactgcatttgagaggagcctgttgcccaggccagaattgcatatgcctacattaatagggactttccatcaggggacagctcttgtgtctttcaaaggggaacaacaaagcgccttctgggcaaagaagagctgagaagtcctgagcctttcttgttcttttgtgggccctggagatgtaataaggccaagaaggtcttcatcctggtggcctgctgtaaaggcaaccctgtagcctttgttctgagccagactcctgctgttgtcatccctgaagaagggcacagtgcagtaacatcgaggcagaacttgtctaatagctgtaagctctgtaaaagctctagtttggaagccaagaaagaaaatgccagacttagaggcaagagagcagcaggccacagtccccacgccagaaagactactgaaaaccatagccagtcatggggactgcctgagtcctaataacagggagacagatgaggaaggagttttaaaatcttaatttcaacctaacaaaataggaaccagctcatacttaacaccagcagcttgttatgtaatcttagaatcagtccatgtggccatcaacatacactatgagtcactgtttgctctattagtattacttgtattgtacctactttgaaaagagttcaacttaacttaaaagtatatatgatggctaagaggccagagactttgaaacagtcagatctggcctgtgactccagtggccacaggcacatgctttgctcttcttccttggttcaaatcagctgtaaatcatggatggattcaaggctatctaagctcatttagtagggataagcaagacaacaatgactgcaaactacccagctagcagctgggctcctccatagcgtacatctaactcaaaaaccaaagaggtaaggaatagagtgtgcaagagagagggaccagtgacaggtcctatcgaagcatctaaataagggaagctttgtacttcctaggagtgccagccaaagggaagcgggattattaccctgttctcatggttaatgaaggaagcctgtaaactcatcaggacagaggaagtgctgaggtactgtaccctgtaccctggagtaaatgcaaatgtgtgtgcatatttacacacacacacacacacacacacacacacacacacacacacacacgatgggggaagaggttgaatggctctccagagccttgctgcccccctgacaccacacagctgttgcctccagtgaagtactgcaagagttaaaacatttttgtgccaatattttaagagtgcagaaggttccaaattacatgtaaaataaacaatgccagactgtgaaaactcttggctgcaacgttctctgatgttaacaagagtttctttattactgtaacctttcagaagtgaataaaaattatttctctgccctagttttgccctccagtaaaagtgaagagagcagtgaccatggaaagagctgtacaataactcccccccccaaggctgggggctgggaagggggcagtcgaaaacaaagccttccatatatatttcttttccaaagtaaaaaaaaaaaaaaatgctccccccccccccccccacgggcggggggagaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaaaaaaaaaaaaaatcccccccccccccccccgagagtgtatctgcatatgtggagtcagaggacagcttgcaggagtaggttctctccttccatcatgtggatcccagggatagaactcaggtcgttaagcctgatggcaaatgccttcacccacagaaccatttcaccaacacagactcccatatacatttagtttgggctatgggtcatattgtacaatgtcacattgctgacatttgtatcacttagaggcacaatagagcatttgggaaagcccaaaccaagctgatactatgaagaaaattaagatctaagcaagaccccttactacttgagactgaagtgcacatctttaaccccagcactggagaggcagaggcagcagactgctctaagtttgaggacagcctggtccacacagagtctaggtcagccacagctacagaaaaggaccctttctcaagacaaacaacaaaaacccaaacaaggaagagggtttgtgtgtggacaatactcaggacaaaatatagtattgtacagacccttgagtcaatgaaacagtaaatatcagacatgcagaaggatcaaaatagagctagagaaagagaacccactttcaccaccacaggaaaaggagtaaggccagcaaatgaagtcaaacactgccccctctctctgtaacactcagtcacctagaaagccatcccaaatgtcatctaacctgagctctctcctctggcattctcagtcatttaattgtgatttctcattattataattatgtttacgtgtgtcctctgctagactaggaagtcttagtcatccttgtatctctgatgcttaacatagtagctgcaagctagcaggccacaataaaatcaacaagacaggtaaaatgttatgcttgatgaactgccatttaaaaacaaaaaagcagaaccagaacataagctctggaacataacatgaggcaagctttttagtcctctcagatgcagaaggttgagtctggaaaagaatgtggagattacctaacttacctctcagggactcaaggggagtccctcaaggactcaaggacttactcaagagtgactaggctggttagaactccttcctttaaaccacacccacaccaccccttcattagcctgaaatggtagtatacatgttcattttctggtaggataagaaatgtgattaaaaactgtatggtgagaatgcaatttcattataaacaaattgggggtgtgtgttgcagtaatggctcaaaggttaagaggaacatgtgtgtactgctcttgaagagaacccaagtttgattcccagcacccatgtcaagcagctcacaaccatctgtgactgcagttccaggagatctgacaccttcttctggcttcttttggcactgcactcaaatgcacacaatcacagacatataattaaaactaaaaaataatatgcaaacaaacaaactatggatatcatgttaggaattagaatcacttgatgtaacaatattaggttcccactaaagctatcagttaccactggacccagtgaatcccaagaaaatagaaacatgttcagacaaaaccttagctcaaatgttcaatgtcaacagactatccataaagagaaaaagcaaagtatgctacaacacaaacagaccttgaaaagatactcagtaaagagagtcaaatgtcaggctgggcgttggtggtgcatgcctttaatcccagcactcgggaggcagaggcaggcggatctttgtgagctcaatgccagcctggtctacagctggagtgccaggataggctccaaagctacacagagaaaccctgtcctgagaaacaaaagagtcacatgtcaaaggctgcaaattatattacattacattctgctgggatgaaaagcccagaaggggttaacccaaagagacggcaggaggggtgggaaatggacagttatgagcacagggtttctttctgaggtgttgggaatgttctggaattagacagtggcgcaggtccataacactgtgaaggtaggtaaaaccactacttattcattgtgcatgcgtgcaggcaagcatgtaccacagctcccactcgtgccccccccccccccccccccagctcccgccaggcccagccatttcatcagccaaaaaaacacatttaaaatgtggaatgttggaagaattatgtattcattttttttgtttgtttgtttagtgaaaaaaatggaattcctccttctaggagctaacaatagaatgagaggagccaggatcagtgaaccaagatgtcttgtgacatgagttttgaagccaggggaagaagtaaatgacagtggttatcttgatactgacactagagctgttgctttctgggcatgtcagacagcacaacgcagtgatcagaaaaggacaagctgcagggagaggggggactgtagcacttgggaggccgagtgagcccttggagactaagtatggtaagttttggggtttccatgcagacttggttaaattacctaaatgggtaacagccttccagaagacccccatgacctctttcctggaacccgtggctgttactttctacagaaaataaagaaagaaagctataggcctgattaagacctttaagatgtagaaatcatttgaaagatctgaagggccctaaatgcaattccatacatccttacaagagaggctgagggagatttgaaccagacagaagaggagaccagaggcagaccggagatgcagccacaagtcaagggatgctggcagccatcagaggctagaaggggaagacatacattctcccccagaaccaacaaaggagcatgggtctagtgacattttgatctcggcccagagaaaatgacttttttcttctatgtcctagagtctaggaatatgagagaataaatttttgttgttttaggtcaccaagtttgtgataatcaatatcgtagctgctaccagaaacaaatatactattctccctgatcttctagttttctcatcagtaacgtgagggtggagtgctatcttgcagatagacagttttaagacaataaaagccaaacagttcttgtaagtcctgattctgtgtggctgcacacccctctaagaactcacaagcagagagcctggattccccagtcagtttctgatttagactctactctctggctctccattaggtaaaagacagggtcagaccagggataatggttctgaaacagaagggcttgttttaaaaatgaaaaaccctgttgggccctgtattagctaatttattactgtgataaaacagtgaccaaggcaacttatggaagagtgtgagcttgtggtcccagagggttagtccacggaggcagggtaagaggcagcaggcatggcggctggagtaggcacaaagaggacagacacagagggagcaaacctaaaatggcaggtggctttgaaacctcaaagactgcccatagtgacatacttcctccagcaaggccacacctcctaaacctacccaaatagtgtcaccaaccggggaacaagtattcagacatctgagcctatagggggcagtctcgctcacaccactacaggctctactcagagctgattcttaacaaactcccaagtgatgtggaggcttcaggtataggaacaaaaatctgagactctttggaccagtcagttcaagcaagattctttttcaggtggaagtctaagcttcccagtgattatctgatgatgaagcactcaggcaataagccactgctgcacgtgctggaacagccttgggacacacttaccctggagaggaagggtttgaaagagcgaccatgaggtgtatggtgtaggctagtttttaacttttcaaagatgcagaacaagtctgaaacacagtgggaacaggaaggcacggtctccttatccagcaagccggccccattttaatttatcttaatcccacctttctgcttctccatcagacccctccctgccatgccctcctctagaaacacatctaggtgtctcttgaattcatttattggctttgccaggagcagcataatactgcctttgttagtctcctggcccagccaccctgttctgctcctctaaagaaaaaaaaaaaaaaaaaaacataactaaggagtctctgaaaaataattataagatcaactgaggcaaattcacaagatgcagagacatccaactctaaatgctgggaaagacagagtcacatcaccactggcatcatccacacctgtcttttctccccttagtctctattagttctgaataagaaacctctgctgtactggattagaaattccaaatgaaaagggacctcaggcttgagtctttctaagaagcaggtatttccagattcaaggaaagctacccccttggtccctggtaatgagaccaatgaggaggtggaatttgggggctggtgtcaggggatactgggaataggaatgccatagctgtggtcctcacgcttccctgtgctagctggacaatctggggcaagccactcaacactgctgagcctcaatttccttaccaagaaatgggaagggactgatccatacagcaatatatagtcttcgtggattgaaaactcagagttaaataatctcccaggtcctcactcgccagtttaagagtgtgaggcccattttccctataaaagtagattcagactacaaccacagaactcaggaggcagggtgggcagagaataatgaaccttttgttggtgatgctggtggtagggagaagagccacagaaaacaaatccaggtatgaccggagacgattgttaaccagatgataatgctacaatggagcacctatgctcacccaacaagaatgagcactgataacaaaaggcacactgatgcacagaacaccaggggcatgagagtccttagcccacctactgtacgttacttgcacaaataaactatggcacaccatacaatgttccagctcacaaatttgtacagggggtgctagggagatagcttagcaggttaagaccactgactactcttgctgaggacctaggttcaattcccagaaaccacatggaagctcacaaccatctgcaactccaagtccaagggatctgatggcctcttcaggcatcagcaaacacaagtaaaaaaatacataaaataaaaaatttaaatctaatttttgtttttacttttgttttttgattttttcgagacagggtttctctgtgtagctttggagcctatcctggcacttgctcggaagaccaggctagcctcgaactcacagagatccgcctgcctctgcctcccgagtgctgggattaaaggcgtgcgccaccaatgcccagctaaatttaatttttttaaagatggctcagttagtaaaatgcttgccactcaaaggacctgagtttagatccccagcacctgcatttaccatttgaggtttttgtttgtttgttaaatcatttgataagtggcagacatcaaaacactctagggactctaggaggaggagagggaaatgatgtaattgtattttaatttttaaaaattgcaaatagccgggtgtgatgttgcacacctttagtaccagcactcgggaggcagaggcaggtggatctctgtgaggtcgagactagcctggtctacagagctagttccaggacagactccaaagccacagagaaaccctgtctcgaaacctcccccccaaaaaaaattgcaactagaacatttaaacattttaatattttaaaaacatataaacagttcaatgttttatttaagaaaatacaacacttaggaagcagaggcaggaggatctctgtgagtttgaggctagcctggtctacataacaagttccaggacagccagggctatatagtgagactgtctcaaaacaaacaacaaaaaaaaaaaaaagagagagagagagagagagagagagaaagaaagaaaagaaaaaagataaaagataaaagaacacatttgcttatatacctacaaaaggttctatacaccacattgccaagatgtttaaatcttgtcccttatgtgatgagaacactcagaggtttctagcatgaaagggacacgatcagatacagggcttaggaagaaggcctctggcagtcggtcggtcggaggactgcctgaaatgaggacagccgagaattccttcagaagtgacttgcaataaagcagagatgaggtctgaagtgaagcaatggatcagtgagggtaagagctacagatatctaaatggcgaccgacaagccatttagacgaagaggagggggcagaaattgagaatgactaagaattcagcttaggaggctcaactgaaggtggtgacatcagatgtgagacaggaaggatgctttcatggagctatttgtcctctgactcggagtgagacttatttggaagaagcattggcagctcctgaaaggtgagctggaaaatgactctggctggctgtatccattgccagcacgtccaccatacactcacctctaaccacgtgatgactatggaactggggacagcaaatgaaaccaggcaaaagaaacaagaagggccagggggagacctgttcccttgaaaggagagctaagcgaggagcctgtatcatgaggagcactaaaggagggatgcgtgtgtctatcacggcctccatgtggaagacagttttctccttcgaccttgtgggtcaaactgtctggcttggcaccaagtaccctcacttgctgagccatcttctcactggtccccagaaaggactttgaaaaaaaaaggaataaagtcactgttccttatataaattctaccaggtatgggaatccagctaaataaatgtaattgaaagaaaagggggggagggagacacacatgacagacgacaactgtttcagtaacttgagaacaacaaagggatccaattcgttatttttatccacttggtgaagacctatttgctgaaatgtctattttttttctttctttcattcattcttttttgtttgttttgtttttcaagatagggtttctctgtgtagtcctggctatcctgaaatgcattatatagaccaggctagcctcaaattcagagatccacttgtctctgcctcccaagtgctgggattaagggttgtgccaccgccaccacctggtttagagctccatttttatgatttagaaatactaagacctcaggaacccacaatttaactgaatgtaaaaatggcactagagatcaatgaccaagtgcacagctgcaactcatttcaaatacagaaaggtttagcaatcgtctttcaagaactcctggttaaaatgaagtgggtccaggcagagcctagtatgtaagctcccccagaggctgaggcaggaggatcaaagtgcaaggtctacctggatatagaagttcaaggccaacctgggcaacctagcaagaccctgttctaaaaataataagcaaaaaggaaggctggggacctagatacacttagcatcctcaaggcattagattggatcctcaacactgaggggtggggaaaggtgccaaactggttggcaaccgcctgagtatctcctcgaatgctcccctgctggcttttagggactggaggttgtacctcacggtggacagacagagtacctcgggggtatatcctctgtggactcagctcacaatgaaaaaactattttgccttctaagaatttaactttggggctagagagaagactcagcagttaaagtgcatctgctcttccaaaggacctgagttcagtacccagcatcctgttaggcagctcacaaccacccgatactgcagctttgagggatctgaagctgtggacagatctggcctctgtgaacaccccccccaacacacacacactcatacacatacacatacccccacatgcaagcttttaaaatctaaaaatttatcttctcctaatatctactctaatatctgagtatgcagctccaatagctcaggccatttaaagaccttccaggagctcctgatgtctaagaaaaacacatattcttattttcatggcctccagtctaaagggttcctcattcatactcacatcctcatgctctatggttaaaaaatacctttgacacacttccttcaaaacctttcacactgagttttaatcctgaccttgagatgtgaagcacagcacaggaaaatagaagtttaagatttttttttttttcattttaagagacagggattacacttaagtccatgagtgtgctaggcaagcattctaccactgagttacgtccctagccctctctggaaatctttatggggagacagagatgggggagggactattagagacttggaaggttggaaggagattttcagaaaaatctaagccttgttaatatccaaatcccacttttgaaacataaaatgccctattataagctagggcttaaaaaaaaaaagtcaatcaattccagtggaaaatagaaaagcattgaaaatagaaacataaagactgacagtaggagacaggtaagacggctcagcagtaagagcacttgctgccaagtccaacagactgatcagttccccaggacctacatggtaggagggatgagctctgcaagttgtcctctgacctccacacacatacttcagtgtgtacacacctgtacacatatgcatggtcactcacgaaaataaatgtaatttaaaaaactacagtaaaggaaatcactttttctccccaaaactaacacagctgacaaatatcctcagaacaacaacaacaacgaaaaagggcagctccatttcccaatacctatcccaggctttcattcttcagatatttactattcggccaacaggcagaattataagcactctggagactacaaagagggatatacacatggtcctgaccctcagaaattcttctagaagatggtcaaaaggcatggacaaccataacataagagagaaagaataaaagcccaaagaaggctacataaattattatgatacttgcagcaagggagaagcggattggtcccactctggtaaaggcaccggggatgaagtatgaggacaatgtaagtgtacacaccgaagaagaaaagacacaagacaggagcagcaaggcatttggcttggctggagggaagggtgcgtgaagcaagaatggaatgtgactctcactaagtgctcagtaaatgccaagcacgtgtgctgaaggttcaagaagcactgtaggaaatgagtttggagcagttgacatagactacaaagtgtgaccagagaggactttgcaatgcagaacactggttctgataagccaagcagtagttcacctaagagaccagtttgcgccagggctccctaccagctcttccctctgttccctctgatcaagcagctcggaaacaaagagcagaggacaggagggtcagtcttactctggagtcttattgaggtaacctgagtgtaggaaccactgatgagaataaattgtaattccttaactacagcctatccccacccctgcccaccttggcttggaaagcttaaacctgctcattgtaagccataaggtggagatgtctggcagagcagaactgacaggaagtcatttcaccagcctaaggttaccattaacactctgagccactgccttgagctaattcttgtttgttttcgaagtttggttgaaatgtcacaaatggaaaatttaagtaaagcacccagttagccccaagcctggacacacctggtgcaaatccagcaaaagaaacttacttcattagtaggagaggcagagtgaaatttacatctgaaagctgcctgcagccggagaaagtactgaggccaaagggctgtctgtttttacagctgtgtcaagtcctggttctcactcctaccaacactcaggagcgaggcaagggccaaggaaaaatggtctccagctcttcagctgcaacccggctcacaaaggtttttaagacccagttaatgaaataaaacaagaccagatgaggtgatataatgaactttatttccacagctaatttatatgtttaaatcccaaatattgaaatattggtgggttttttttccttttaaaaagtcagaacactaaattatcgatgtgatttttgtaacctcaaatttagcagttgctttttgcactggcttcaccaatgacacatgagtctgagccatgtgccaccacagctgggcttcttagaagccgatgaaaagcaaagtttcccctcttatgagaccagaactcgaataccaaatgagttcttgattggaattcgggtttcaaaggaattgttgattaaaatttctgactcgtcatcagtttgcaagaggcgcttttgctcttgatctctgccacacgcatccactcaaagtaatggcttctaagaattctttggcatgagaaaaaccgcaccattgactggctttgtaagttttactttcttctatgacttttcttacagaggtatacctggaacgccaaataacacagaaagatttgcaaattaccaccttcaaatctggagtttttcaaagctgaaaagaaactcggcagccatgtagtcagcaccttggacctgcttctgtgtcctctagagcacaggaagtcaagacttgtccactgtgggagaaccaggccagactctattcattccacctactgatttcaaagtcacatgtccccctgctgtgggctgtacactaacactgaaagcccctctacctgcacactctagtatacatctgtcttcctatagaaaaggtgcctgtttataccatcaagttagaaagggggagtatcaaatataataaagccaagaacagtaattacccaattcttctaaatttgtatttttaaaacaccgtcttccatttgtagtttttgtcactaagccagagcttgggcatttctcttcatgaagataatttagaagcctaggggaaatcactaacatcttgctattttaaagtatggttgtcacctcccacacccctattaacacaggcaaaacctggaagcttctcagaagagtggacactctaaactgggtgtgatggtgaatacctgaaatcccagcccttgggacatgtgagcaaaaggacaaccagagatacaaggtcatccttagctattcagtgagttcaaggttcagggtgggttacatgagatcctgtagcagagagacagaggagagaaaacagtctcaggactgaggatatggctcagctggtgcagtgctgggttcactcccagcacagcataaaaggggatggaggtgccccctacaatctcagcattggggagtggaggcaagaggatcagaagtttaaggtcatcctgggttacatagtgagttcaaggcctgcctgggctactctgttaaagagagacagagagaacaagacagagagaaaggagagaagaaagaaagggaagggagggagagcagattccctggcctttgtcagagacttactgaatcacatctgtgccttaccagggtcaccgaatgaactggaggtgcactaaaggcaggaacactatgctgccctataggatggcacactgtctaggaacaatccgaatggacaaaagaggagaaaaaaattaaaaagacccctgcaggactgtacagaaaggaatgagtcaagtaccattaatctaatgttaccttaaaacagggtatattagcatcatggtgcacacctttaatcccaggacttgggaggcaacacaggtatatctctgtaaataagagaccagcctcgtctacatagtaagttctaggccagccagagctaactattctgtcgcaaacaaacagaatacagcagagactgcagtttactttgtgtcctccctcattcaacccatcctatttgtccactagacatcaccatataagcaaatagagtgagacagcctcctgttcccaaaagcgtaagccgaaggaaggagagggagatcacacacaaagcgcatggagaagggcaaagtggcagctgctgggacatatggaagagaaattcagcgggagagggtgtaattaaaaatccccgtggtccacaagtcagcaatttctggattattaagctatttaggacaggacagctgtgactcacatggtcccagaggtcccactgccagcaaagttcagtcaacagagataagccaaacaggttcatttaatggaagggacactaacacaacacctggcagtccacgaaggctttggctggccagcgggtattactggccatcactaatagggtgagttgagatgccaacaccaccctaagtccaatgtgtgctgccacagaattgagtagtaaacacttgaggacgtagaaaatgcagctgtatgagttgctagtctgctgacctccctctgaactgaaagaatgccagcaggcatgacagtgggagaaatgaaacaagaaccagaggacagttacaaaaagagctcagtacagggccagagaggtggctcagggtttatgagcaccacttgttcttgaagaggacctgggttcagttcccagcacctacatggtggctagcagctgtataagtaaagggagtagagggatctgacgccatcttctgaccaccttgggctcctgcatcttcatggcacacatacatacactcaggggacacatacatacacattagagagctcattcgtgacttcaaggcaggtggtgatgataaaaggtacaattgatgtttcattttctcagaacaaacagaaatgccaatggtatgctgtccccacagaatgtaatgtgaatgcccataaagatactcaaaggcaaacccatgtttacagtgcttcctacactccagttcattcagagacataagaaaaccctcaacccaggatcccaagaggaaaccatgttccacatgcatggtataagtctcaaagattgcaattttacacaagcaaaagtacacggggttaacaggcagtacaataggagtatgtgaaatgggcaaagtaacaaaggtcagccatgactgaacacccatgtagcatggaaagacctccaaacaatgctgagtaaagagagagttgcaggaaagtacataaagaatgagatcatttgtaacaaaacatacacacatgcacatatgtataaaaccttctaccacacattttctatagctagcaatcattttaacacatacacaaatgtgcacacacatgcacaaacatgaatgtaaattatatatcctcttctctcaggctaattactgaatttactaaggtatttatttatttatttatttatttatttatttatttatttatgggacagggtttctctgtagctttggaacctatcctggcactcactctggagaacaggatggcctcgagctcacagagatcagactctgcctcccgagtgctgggattaaaggtgtgtgccaccaacacctggactacggtatttatttttaatgggtagtttgccaaaatcttctaggttgctagtgaccagggttttctttagttcctaggactacaggccccacaccaggatcttcccataaggactaacttagagagtccaggtactgcagtgcatgcctataatcttagcacttaggaagtggaggcaggagaatcaggagttcaaagccaccctcggctatatagcaagtcccatggccagcatacataagtcaatgtctcaaaaaaaaaaaaaaaaaaaaaaaaatcaaaaccaatcaaccaaaaaacttaaaaggggaattaattcaaacattgaataatgtcaaaggcagtgtccttagactagattagacatttggttccccattccatcttccctacaaccatttcctatctacttctgtatacaagatgtcctcatacccacaaaccacaatcatgtgcacaaacccataaagcatccctggtatgtcaggctcccaagaagcacaaaaagggactatagctgaacagtctctttgacattagggaacatttcacagaaatccaaaagcaaagccatcctaaagaagaaagaacctcagactcagggcagacattctttcaccacagctgtccagaccggcatctgcaggcaagcacttacccccataactctgcctcgctgctccacgtcttcccacataaaatggactatgatccggcacatgtattttccagaccggccttcctgcttcattcggactagacacatcctaagtggaagcaaaaagagtcactgaataactgcattttttttttcacacagttcacagaaaagagattttagcacagcatatggaatcaaaattcaggagtgaccttgggtctttaacacagtcacagtttaaaaaacaaatgtccatctgtgcagtgaaaaaaacttgcgctgggcagtggtgatacaagagcacttgggaggcagaggcaggaggatctctgtgagttctaggacagcctggtctacagagtgagtcccaggacagctagggctacacagagaaaccctgtctcaaaaaattaccaaaagaaagaagaaaaaagaaaaaacttgcatattacatatgataatgaaagcaccattgaaccagggatacctcaaaagcctccttcccacatggaataaatcctatgtggttattagaaagacaatcaagcagaattctccactcaactggggaaaatatttgttcactactacagaattttctaaatgtgggtaaagaatttcctgtctcgtatagtagctactagctacttgtggctactgagcactttaagtatagctactccaaggatttcaaagatatagtaagaaaaagaatcacattttaaatattgctgtcacattgaatattatttcatataagtttaaataaaatctatcattgaattaatttcaggggctggaagatggctcagtgaagaatggagttagaatcccagcacccataaaaagacacgtatggttgggcatggctgtaactgtaccactgggggttggagacaggtggctcccaagagctccctggtcaggcagcttagcccaaacagtgagcttcaggcccagagcaataggaacccaacaccttcctctggtctcccatagtacctgtacctgagcattcatttgcatgcaccccctacagccacaccctccacatgccccacacattaaaaaaccacctttcttttcaaaaccactctcatttctttttactttaaaaatgtaactccatatgtagaaaattttcaattatatttgtggcttgcattctacttttcttggccaatatttgttcagtatacagatcactgagaatattatgatcacatttttataattatcaaattgttctcccactagatgtaaattccattgaaggcaaagatcaagtttgtttttgtttgttgttgctttgttttgagacagtgtctcagtatgtagccctggctgtcctggaactcactctgtagaccaggctggcctcaaactcaagagatccacctgcctctgcctcccgagtgctggactataaaggtggacatcatcacaccaggcaagaattatgtaattttgttttgctttgtttttcaagatagggtttttctttattgctttggaggctgtcttggaactcactctgtagaccaggctgacctcaaactctcaaagcctctgcctcctgagtgctggattaaaggcatgtgccaccaatgtcgggctgtaatttttattaatttaaacatatatttaggggcaggagagatggctcaatggttaagagcactggctgctcttccaggagacccaaattcggttctcaagcacccaatcaggtggcccaggggtaccccaggcttctggcctcctcatataccaacactcacatgcacaaacccacacatgcatgtatttaattatacaaaagaatataatcaaggttactaacttttcaaagtagttcctaatattcttatgaccatactaatttctaatgtcttgaactaggtattaaatgactgcaacagactagtcagctgaaagacaatccctgctataatttcagaatgctataatttatctaaattgacaagtctatctccatacaaaagctgcccattaaaatcaactaaaagggggctgaggagatggctcaggagttaagtgcatgcctgtggggatctgaggatgtactgagtggataaattttgacacaggaatgtccacatctccagaatgcccaaagccacagacccatgagaccattggtaaagctgttaccagtatgaacaggctcaagagaaatggcagagctgttcttgagagtcaaagcatagatggctattggtattgcacaaagattagcaactgcaacttcttcctcctgaacaccccgaaactgctctactatagagacctcctactgagactagctaaccccttcccgggtgctgtacctgataaacacactgatgttctaggttgtggaggtagcagttgcattagagaagcccgcctgatcccaacttcactgtacaagtgtctgtctgttcttcattcccttactgccactagtagcatgcatgcactgccattgcagagaacccaaagtcagctcatagctccaacagcaggggctcacagtggcctgtaactgtagcaccaagggatctcataccctcttctggcctccttgaacacccacacacatttacataagtaaaaataaatctttaaaaagaaaactagtcacaagcagtggcatctgcctctagtcccagcagaggatctctgtaaaggccagcctggtccacatatcaagatcctgcctaaaaaaaaaaaaaaaaaaaaaaaaaaaagagagaaaaagaagaagagggagggaggagagagagagagagagagagagagagagagagagagagagagagagagagagagagagagcgagagagagtgcaggttcatgcttagagcaggctatagggggcacacataaacaaattccagtacgcaggagacaagaaaattgcaaattcaaggccagcctgaactacagagcaagaccctgtctcactatgctgctctgtaaaagaaaaatccacaagcaacaatggaatgattccaatctgacttgcctcaacatctctatgaatgactaaattggaaaaagaaaacacacttatcaaatgggcagatgacaagctgggcaagagaacaaatatgctacatgacccaaccatgacccaaaaatatctccacaagtctgtctcaatgggatgcaccttacaagaatctgaatgggggtggagaggtggggaaggttctgtacttgagtctagtggctaaaactccagaggtccagaatacatgaatgacacctaccaatgtaaaaaagcctttaaaaatgaagataatagaacacactcagtgcaagtcaaaagaataatgatgctgaccccaaattaatgttctagatacaattgaaatatgccctcaatggcaaagtgagactccaaatctgcttggaatagcatctactaattctaattttgaacatcattatctgaagaggtgaggttacagttctgttctactgcacagcaatgagactacaataacaataatgaaatatacttgagaatggccagaagagaggattttaactattctcactccacagaaataatatgagatgatggccctggtttgattataacacaatgtacacatgtgtcaaaatattgtataatttataaatatgtataatgatgggccaattaaaattaagaagatgaggaagagaaaaaagatgagtgagcaggctggcaaggtggaaaaggcaattgccacctaatcctggtggcacatccagcagcaagtatctaaagatttaagtaactggatggacaacttcaaaatgcagaaaactagctttttcacataaggagaacagatgtttggtgtagatgaagctttttcattattatttataggcagtgtgggcagcccaagttgagtgctgggaaccaaattcagctcctacaaaaaagcagtgcctcccttaaccactgagcacctccgtaccctgagcagttcctcccgtaagcaccgagcatctctggagcctgagcatgcagctttctaactaaaggttcactactaatctcaagtggatttgttggtattttcattctaatttttagcctctgaacccagttcataccaaaaatataagactttgagacaataatgaagaccgcatgataatatacaatagggagcatatttcaaagtagaaatgcactgagttaagttcaacagcactttctttataagacttttctaaaagttagtcaaattgttcttgtcagcctttcacctgaaaatgtgcaatgtgttttgatgcttaagtgtcataggaggccaattcatcaacagcaatagtgaggtaatggaattcttcatttatttgaaaattctgttaatacacctgccctctggggtttaaaaggcacagattttttcagaccataaactttctaactatatcaacatgcggtgaggtgttgtttggggtttcacagcacagcttgttctataggcattataagataatggttagcaatgacattctatgctggagagaatgtggagaaaaaggaacattcctccattgctggtggaagtgcaaacttgtacgcccactttggaaatcagtatggcagtttctcaggaaaatcggaatcagtctacctcaatatccagcaattactctcttgggcatatacccaaataatgcatgttcatacaacaaggacatatgttcaacttttttcctagaagtgttgtttgtaatagccagaacctggaagcaacctagatgcccctcaactgaagaatggatagagaaaatgtggtacatttacacaatggagtactactcagtggaaaaaagcaatggaatcttgaaactcgcaggaaaatggatggaactagaagagttaccatcctgagtgaggtaatctagtcacaaaaagacaaacatggtatgtactcactcatatatgaattttagacatagagcaaaagattactagcctacaatccacatcaccaaaggaattagaaaacaggaggacccaagagaagaatgcatggcctcccggagaaggggaaggggacaggatctcctgagctaattgggagcatgggggtaggggagagggagctgggagagaggggagaagaggcagggagaagaggaaatgggggagcaggaaggctgagtcgggggaagaacagaggagagcaggatgagagataccataatagagggagccattataagttcaaggagagatatggcactagggagatttccaaagatctacaaggatgacaccaactggcaatctaagcaatagtggagaggctatcctaaatgcccttcccctataaagagactgatgactaccttatatgccatcctagaggcttcatccagtggctgatggaagcagaggcaaacacccacagctaaacactgaactgagcgttggaacccagtttcagagggggaggagtgatgagtaaagaggtcaagaccaggctggtgaaacccaaagaaacagctgacctgaacaagggggagcatatggatcccagactaatgtctgggaggccagcatgggactgatccagacccctgaacgtcgatgtcagtgaggaggcctcggcactctatggggcctttggtagtagtaaatcagtatttatgcctggcgtatgaaaggactttgggagcccatcccacatagagggatactctctcagcctggatacatgggggagggcctatgccctgcctaggacgttatgagagactttggggatccccatggagagtggccttaccttccctggggagcaaaggggggatggagtgggggacaaatggagggtgggggaggaggggagggagagggagcagggattgacctgtgaagcagacttgtttctaatttgaactaataaaaaaataatttcttggggaaaaaaagattaatggttagctcaatagtcgtctgtgctaaaaagataatacaaaatgaaggtactctcacactgactgactacccaatgaacagatcctgagctcctactgcatgtaggtaatggtagaatgaccaggtattacagtgatggcaaagacatgagtccagctttcaagctgtgtgtctcctaggagaaacaaaacaaggcacatacaaacaacagggaaaggtttaataagatagctcagtgggttagggcaattgctgccaagcctgactccctcaaacccacatggcagaaggagagaactgattcctaagagctgtcctctgaactacacaccatggcacatatgcccacatgtgtgcatacacacaataaagaaataaataaacaaatgtaaaaaaagaaggcagcatctcaaaacatgcaatggagtttgaaagaacactttgggatgaataggatctgaagaagcttgacgggaaatgaaacattatacctgaggcttgaaaggatgggctgaaatgaagatgcaacaaacgtcaagaggcctttccaaaagacaggcacggagaacaaagccagggccatggaagaagtcagcacatgtcaaaggaacaatgaatacctaaatttgtaacagggtagagtatgagaaggaggaaagtgaagccagaggaatcctgagtgactctgtaatgtcatgcagagaaaagtctgaacctctctgggctaagcagtcaacccagagccactgggagaaaaaaatgtgaagagattaccacgttggcactcagagcagaagagtcactgagacgttagctcttattcccagccttagcccacaattaaacaccaacatcaccaaggttggaagcaacaaaatggaggaagtctttctttgtggaactgaggtctttgtccagtctgaaaatacaaggttgccctgccttttgagagaaatgtaaacagcgacgtttgttttaaacctctatctaactttggtgttcctaacagtttaggaaatagtttagtattgacagctatcaaccaaaaaagagaaagttcaaattactcctaaaacactgcatcaaattagttcagtggatgtgtgaccaatgcaaagcacttaacgatataaagctcaacagcaaatatctccttggaagaccaagaatcagttttcctctcagcgtatgtgctgaaagttcctgtgttgtaaggaaaatgtaagattcagaccacagggccctccagccactaacactaactaaaagttcatcaatgtacaccctgaggtcatgaatcaaactctgtaaggagctaagaacagaagaaaactcccattgtaaagaactttcgttcttactctccagaaagaaagaaagaaagaaagaaagaaagaaagaaagaaagaaagaaagaaagaaagaaagaaagaaagaaaagcagagctggagaccacacctatgtggtaaaacaggcagctgcctaggatgtccaatgagcagttcaaggccagctccttcaaggtagggtgctaccttgaagctcacacatattcaattctgcttcttcccctgcacagtaactgctttgaacagataacacacggaaggaaaaggaagacaccttcctaccccttcccaagcagtcttcagctacagcaactagctccccgggagtccttccatataatcttatcacacacagttccagtgtccaagtcttcctttctatacatggcagtagcttttcctttcttcaccttgctaacatctacacacattattctgacagtgagaagcaaagaggagaatccctggaagcttactgcccccaccccccagcctagcccatgcagtacaacatccaggagactccaccttaaacaagatggaaggtgaagaccaacacccaaggttaccctctgacctccacataggcaagtgacgtgtgtacacaaacaaacataccaaacagttagagtagtatctgccacaggcggaactcagcttatctggcaatttttaatattctacaaatgactaagaaggaaaaaattaaatagcaaaagagaaaaaaatgctataataaacagccaacactgctccatactaagccccctggctaagcgctgtaggtgcatttctttcttgttttcagagttttgttatcctatatacctcaaactaccaccctgggcatgtagcttacacctgtaatcctagcactcagagagactgaggaggacctccgttagttcaagttcagagctagccggaaccaagttccagaacagtctggcagaagtatgagactttaacacacacacacacacacacacacacacacacacgggtgagacaaggaccctcctgtctcagcctctgcaactctgatgctcacactgtctcaattccactgttgaaaaaaactcacctctgcatctggggttggagagacagcacaacagttaaaagcacttgttctccagaggacctgggttggattcccagcactcacatggtaattcagaaccatctataactccagtcccaggggatcagatgtcctcttctgacccccaggagttccaggcatgcacacggtgcgcagacatacatgtaggcaaaacatggatacacttaaagtaagaatactttttagcgaggcggtgatggtgcatgcctttagtacaagcatttgggaagcagaggcagatgggtctctgtgagttcaagggcagcctgatctacaacgtgagttacaggacagccagagctacacagagaaaccctgtcttgggggagggagggacttaagtgacttttaagaaaggaagaaaaaaaaaaaaaaactgtttagagcagtaatccctccaacaatacaaatctagtgagacctgcacctagaattatactgaggcatgtttgtttgcctccttcactgaccacaacaagccctccagaatctaccaactcaattttcccttgaatctttacaggacacactttaagttttaaaactagcatcacattagaaaaagcatattggggactggtgagatggctcagtggttaagcacactggctgctcttgcagaggaccagagttgagtctcagcacccacagggtggctcagaatcatatataactcttgttccgggagacccaatgcccagatacaccagatatacatgtgatggtacacacacaaacatatgaacacaagcaatacatttatacacataaaaaaaattttaaaaacatttttgtaaagaaaaaacatatggggaagaggagagatggctcagtggttacaagcctactcttcaatctgctcttctagaggacaaaggttaagttccaacaaccatgtcaggtggctcacaacctcctctagctccagttctaggggatacactatctctggcctctgggcatacatgcacatgtacacacaccccacacacactttatacctattgaaaaataaaaatctaaaatccataatggaaaaaaagcacactggaagggaaagatgcctaaactgatacaaacctacctataagaacaaaagccactcttggaaaggaagaaactaaattgtactaaagataaatacatacccaggtatgacattgcaagcctgtaactccagcactggagagaccggatgaaaaaagacactaacaccctaaatttgagggcagcctaggatacacagggaaaaacctgtctcaaaaagcaaaaaggtagatgaaccgacacccccaaactccaaataaaccaattaatggtaaacagaacagaataaaactaccaagtgagattcaaagacaaaaatacaagctggaaggtaaagcaaaattaatgaaacaaattcaaaatggctcatctaaaaaactagacgattctagggcctactctaaaacaaagctaatgtgtcacatcctatgagtcattatgagctagtcaacttccagaatactaagtttacacaaaagaacctaacagctgaactccaaccttaatcgacactgtgaatgtattcctcacactaatgctcatcttttttcttttcttttcttttttttcccccagacagggtttttgtttggttggtttggtttttccagatagggctcttctgtgtagtcctggctgttctggaactcactctgtagaccaggctggcctttaactcacagagatctgcctgcttctgcctcccaagtgatgggattaaaggtgtgtgccactgtcgccgctgtcacccggctttttagacagggttttatacagctcaggctagtcttgagcttcttgattctctgctttcgacttccaaagtactgggattacagccctgtaccatcacacccagatcttatgttaaattttgaaaagggctcttttgggggaaggaaagcttacagactaaaacaaaaattatcctcatgaatgcaaagaaaattcttaataataaaaattcttgcacttgcttcacaagtccttatgcgcacctacttcgcacacaggctgagctgcactgctctacagggattctacacactcctcccaccgtcactgatgttcttaaacccacaatttattattgaggttttacgcctcagcactgtcctgtctctcagtgattccagtggctcataaataatcctgatctcttttacatataaggaaggcaaacaacccagctagcaaagtaaagaaaaaaagagtgctcaagtcttcctgacggctcctcatctctgtaaaaggccaacccaaagacggccaaagaggaaaagctcgctgagcatgagtctcagataaaggactaaagacactgaccgcctcatgctattaagttccgcaatagaagacttcatgcgtctgggcccaccaccttcctctatttgcacaattacacatctggtacagctctctgcatttcacagaaaaccaaggtgcttaagtaactaaggtggcacagtggagctgaagcatagctagagctttccccaagccagtgtctctaaattagctcttcaattcagcgatggcccagcaccagtggcctcttcctgctaggacggcatccctgtctgcacagtcaaaagcaacaagagcctctctctctcctctcgagccccggagcaaggccacagctcttctcaacatctatccaaagggtagggttctttaggacttctgccacatttgggcagcctgtcgcactcagcatgtttagcatttgcccttgtttgaccacataagctgcttttaaggggatctgattctaaattcagtatcagtgggcaggtgagcaggtctgtcacactggctactatgaagaaatctcaagtggaactttcctagagcttgtttgccttacttagcatcagctaaggccataaaagccaggccagcatggccatgatgatgccccttagattgctaatgaatggtttatttattggtgagctggcacactgacgctttcctggggccatctctaccttgtttctgaaacttcccccctgtgaagtctaagccttctagggggagcacaggagccaccagacttgtcagtagcaaaagataagtgggggcaaaatgcttcctgaaaccatcttcactaaacatataacttggttggcttggcaagtaccagggcactaaaggtcatgtgtgctggtaaaaggcagccgcgtgggcctttggtttgaacaaaagtgaaaaacaaccacctatacttgtgggggtgggagcaaagactctggctgggggcaggagaaagaagctgtgcacatggccaggacatatcgcaggtctcaagctattggaatccagcagggccaggatgccctacagccacgtgaaagctgctggggtgggtttaaagaactcctcgaaaatgcggccagtgcttgtcaggcaggcctctggccacactgggatggagaaagaatgcttcccaaaccctttcccacccagtttacttcctcttctttacaagtcttctcatctggcttctctaatgttcagtctccatctttctttggaacttgaatttttaaaagttacttcttcctctactcactgctcaggccatcctctggctctcgaccccagaaggccaacaattgctgtccttaaccatctaccatttccagggattaccaggacacagacagtgcataccaagaaaggcaatgctcactttatagctggcaatcactaagtcatttctattgctattcacattcaggggacaagacccctatcccctagggacactaagggatgaacagctaacacagtcagctttggctttgtctcagatcctccactgctgatgtggaacatgaagtgacctgtgacaaatatcataaaatcaccaaaaccacttctctttgtgtaagacaagggaactgaactagatacatggtttttaaaactgccttctgggttcccatgaagctaccttcaggttccttttctacaggtatgttatacagataagaagtgaccaggtcattcccacatccttcaatccaagtagtagtcctctcatccacttacatagtatggctaaggatgagatttcctgtgtgtgtgtgtgtgtgtgtgtgtgtgtgtgtgtgtgtgtgtgtgtgtgtgtgtgtgtgtgttgcgaaaacacacacagggcttggcatttaagagtgcatacggatcttgcagaagacctgagttacagaatttcaaaaaatgtacaatgaaataaccaacaacaagatttataacttgaatttaatttaaacattacaaaatgatggggggtagggagagtttgagactagaaagatggctcaatggttaacaccatgtacaaacacacacatatataaataataatattggtttcacttttgttgttgtttacacagagtttctctgaatagccctgactgtcctagaacttgttctgtagaccaggctgacttcgaactcaagagattcacctgcctctgccccgcaagtgctgggattaaaggtgtgcaccatcaccacccagctcacttattgtcttagggtttctactgctgtgaagagacaccatgaccacaacacctcttataaaggaaaacatttaattgatgcggccactttcagaggtttagtctattatcacggcggcgtgcaggcaaacgtggtgctggaaaattctgcatcttgataggcagacaacaggaagtggtctcaggtactggatgtgacttgagcatatgagacttcaaagcccaccctcacagtgacaccaactccaacaaggccacacctacccaacaaagtcacacctcccaatagtgccactcatctggggagccattttcttccaaacatccgcattccactccctggaccccaaaggcttgaagtaatatcatagtacaaaaatgcattcagtcaacaaaaacaaaacaaacaaaaaaagtcaggcattgctagcacatgcctttaattccagcatttgggagacagaggcaggtggatctcagtgagttcaaggctagcctggtctacagagagattgccaggatatccagagctattacacagagaaaccctgtgtcaaaaaacaaaacaaaaatgcattcagtccaacttcaaaagctgggcattggtggtgtacacctttagtcccagcagttgggaagcagaggcagatggatccctgtgagttcaaggccagcctggtctacagagcaagtgcctagataggctccacagctacaaagagaaatcctgtcttgagaaaaaaaaaaaaaaagtccccataatctataacagtctcaaactattcaaaagtctaaaattcaaagtctcttctgagactcatgcaatctcttaactataatcccctgtaaaatcaaaatcaaaaagcagatcacatgattccaacatataatggcacaggatacacattaccattctaaaacatagggaagggagcatagtgaagaattactggaccaaaccaggactgaaaaccagttgggcaaactccaaattctgcacctctacatctgatgtcaaagcgcccttcagatctccaacccctttcagctttgttgactgcaacacagttcttcctcttgggctggtgtgtcatcccccccccccccccaagcagctctccttagcaggttccccacagctttggcatctccaacatcttgggagtctccaaggcaagccaggtttcagcttcacacaatggcctctctaggtctcttttcaggaacacccctgacacaagcctggcctcagcagctttccttagttagcctcagaggcaaactcctagcccctttcttctatccttaactctagaatcatgtggctgaagctaccaagttctgttgcttactggggctggaacatggccccctcattcaatcacatcatcaccaactttctgttttcaatggttaccttcactacaaatgcttggctgttctggaactttctctgtagaccaggctggccagcctctgcctctggattgctggaattaaggggatgtaccaccacaccctgctttaagcttttctttaattccctttctcaagttggaaatttagctgggtgggatcttgcccctgaagttaccactccctttatttcatttcttaatctgtttatctccttgaacacaggacttagcgccattccacttgctggtgctccttttctcctcaaatattttttccttgctcagcttgttccttttcattataaatcttcattagagttaacatcagtacccacacaacagagtctgtattggggtgttttgagattccctctgccaatggtattaatccaaaattttcactttagcctcaggcagagttttcagacaagagcaaaaagcagccacattcttcaccaaaataccacaagaatgatctctaggcaacgtactaaaattcttctctgaaattcttgagccagcaccgccacagttcatctgatgacactcagcatcactgtcttccatggtcccagtatggcccattacgaagcacttgaagcattccactgctttcctaacccaagctcccaaagtccatattaccctaaataaaaacatggccctcccatcacagcaatgccccactcctagaaccaacctctgattgagtaagggtttctgttgctgtgaagagacaccatgaccacggcaactctttttttttttttttttttttttttttgagacagggtttctctgagtagctttggaggctgtcctggaactcactctgtagatcaagctggtcttgaactcacagagatccgcctgcccctctgcctcctgagtggctgggattaaaggtgtgcgccaccaacgcccggcatttgtttgtttgtttgttttttggttgaccatggcaactcttataaaggaaaacaattaattgaggtaacagtttacagtttcaaaggtttagtccattctcatcatggcagggagtatggtggttagaagtatagaggcacagacatagccctggagaattctacattgtgataggcaggcaacaggaagtggtctcagacactggacatagcttgagtatatgagaccttaaagcccacccccacaaagacacgtttactccaacaagaccgcacctattccaacaaagccatatctcctaacagtgccactccctttgggggccgttttctttcaaactaccagttattataatattattaagacaaagggtgataaagcaggatatccaaccctctcctttggtctctgcacatataagcacatgtaggaggacacaaacacaagttatatagtgtacatatgtatgtattgaaatactatacagcactccattaatatgtataatttttatgtatcagttagattttaaaatggaaagaaacacctaagggccacagaactgccttcagagggaagggaaagcttacgatgacaatagtggcttaatcagatactgaggaaagaagatttgtccagctgtgagaatgataaatacctccagaataaagactccacagaacagtagcagacagcagtagtaaaagcatctttactactggctgaatcttacagaacatgaacaacacactaagaaacttgagagccaaggtgggaatccaggtactggtgggtgcaccccaatgaaataaactcagtgggagaaaccttcaacttctgctaaaattagttccaatagaataggaagtatcagacatttcctgacattgcaaaacacaaggtttatttaatgtttgcatccaatactacaagcatgcatactgggtcacaaagtaaaattaatttacttctgtgagctcagggtcaagagtttgagctaggcaactaatgactgactgaccaggttaaacaaatgaaggacatatcaaaaaggaactcccggtttctggtacaggtatctgaatgggctcacaatgaatggctatatcaaaaaggaactccgggattctggtacaggtatctgaatgggctcacaatgaatggctgggataaggaaagttaggagggctgctttaccaagccagtgtagggatgctagggatttccaacagcatctttttcagcagccacattcaataatgatcgtgttcagcagggacaagggacacagtcagtgccactgcaagctcactgaatatacaactaacagaggtcttctaggaacacaagaggtatgtggtcttaaatctcaacccactgaaaaactatggaaccagaaagagtagacagacaggagaagtatagcatcttcagagagcatacaggatggctcggtatcctgttctatcccaactaccaataggatccactacctaggggacccaggcaaacattctggaaagtctatcatcagggcactttcatttcctaggagtctctctggttttgttttgtctttctttaggactgtttccttgtctcctctctcagtttccactccaaaaggtgttatagtttgtattcctccagtggcacagcttacttcgatctctaaattggagtttggctgcccctcagtttggactcttaggaaagggagttctccaattctgggaagatcactacacaactgtgtaggggacagtaagccacgcctgttagaggcttgtgcctgaccacacctgtcaaggcgtggtcaaggtgaggtcaggatgatgcaggatgggctcttaaggggctgcagagcacatgggaacccccttctccctggcctcgctgctcggctgccctgggcacgctctggcttgcgtttggctggtatttatctcaataaagatatctgaccttacggactacggatcatctattgtggtcacgcaatacaactgagcccaaaactatttgtttgtttgctttttgtttttatttctgtagacagggtttctctgtgtagccttgactgtcctggaactcactctgtagaccaggctggccttgaactcgaagagatattcctgcctctgcctcccaagaatgtggggattaaaggcatgtgctgccactgccaccaccacctggcttttttttttttttttttttcctcaaaaactacttttctggtcaccctttgactacattcttccacgaacctgtcaccaaaaatgtcagccaactggctgccctcaaatacctgcaggtgcagtctttccctcctgctgctcttcagaagcgccctctctttctaccacagtcattttacttactcctcatgatctctatccctcacacattagctctgccctacactgtcctcactcctgccactgaattcagacttagttctacctgtgtgcttccacagcacctctttgggctttgcgccaaacatttcattagcatctattatagacaatagcactcaaagcccttttccaatacagtttcttgaatgtgtgcactgtatcacagcttctctccagcaccccatggtcccaaacacacagtaggtccttgacaaggattttctgactcaaacagacaagatgttctaccaaaacctatttagatcatggcaattaagagcaatgaagagacgtggcaggcagtggtgcgcacgcctttaatcccagctctcgggaggcagaggcaggcaggtctctgagtttgaggccagcctgatctacagcaacaaagagaattccaggacagccaaggctacacagactctgtctcagaaaactacaaaggaaggaaggaaggaaggaaggaaggaaggaaggaaggaaggaaggaaggaaggaaggaaggaaggaaggaaggaaggaaggaagggaggaaagaaagaaagatcccctcttctacttagctggtggtggtgcaccccactcctcactcagctgtgtgtggtggtgcaccccactccttacttagctgcgggtggtacactccattcctctgaaaagttaacttcagcaagaaaggttgagtagacattttggcaagtttaaggaaatacaaataatttcaaggttctccccactgctattagtcaggtattgaccttgggatgtggttgcagggattatatattttactttgccatccacgccctctgccactctgatacctctagctatatgggcaataaagagtctttcatacaggctctgaatattatctttgagctcctctgggaacaacttagccttctctcaaccctcccacctttccaatgagtaattctaccatacagtcctcagctctcaaaaaaagtagttttcttctcaatgtatccagtttccctccctgtaccctcgccttaacctccaccatggacaccaaaggcagactgtgccttctcagctgcctgacaagaagccacagtacatatctcagagaagagaactaggaagggtctcaacactgggagcgtcctattcaatcctataagcaccatttacatatatccagaacctagcagccctgtttataactgggcatttatgtgtcctagctccctcactaaaactgggcttcttgagaactagccctagttcccagcgaagtgcccaggacatagtgtaccttctataaactaatgcttcagagggttttaaaaaaaatccataaaataaattgccccttcaggctccctagccaaactcagtgacgatgtgaatttggaagaagaaacgtttcagaggtgattataactaaaacatctttatatagtagccaggcctgtgatgcaaagctcagctaaagacagtctcaaacaagggtcctttgatgggcagccattccccacgttccttggactgctcactatggtgaatgtagtaaacccagttctccagagtttactttcccaagatctggcaagtcccccagcccccactttagtgactcctatatccccctttgacctttaatgctgtgtaacagtagatgaaaatcgattttttttttaaggctacttcacatctgaagaaaaaatatactgtttaaggtgttaaatattttcatatgcaacaaatccagcttgactctaacctgcacacacacttagaggcacagacataaatgtcagtggtaaaatttgttataggtttctgatgaccagagatggaaatgaccacggattctcacaattcaaaccacttttacgtaaatgtgaactttcctaaaacacccaaggggagaacttttccactcgacctcagagagtctcttagagatactgatagcattattcgtggggttaggtgttctttgaaaaaaaaaatattacaaatattggtttcttttggggtttatgctttgacctttaacaaaaatgtgcttcaaggcaccagttatgaaaatgaaaggagcaggttttcatgcttaaacaagtaccacttcatataatcaagactcaaagaaaactatacccccgccccccccccacatacacacacgtgcaattggtgacctcattcaaaatggctcacttaccagacatgaagcagagttataagaaaccatgagttgaatgtatcgggcatctgacaccctagaaaataacaataaagtgtaaatataagaaggtgcagaggaggcatactgactctgtgttagccactgctgggaatgtgcagtatggccattctgactatgctattgcagaaaagatcagtaaaaactcaatgtaagaccatgggctagaggacggaatatagccagacaaccagccttccagttccaaccttgttaccgccttgtggccttgggcaaactgcatcttccctctgagtctcaaacacctcattttacagaatgtgacagagatgatttcttatggctccttccaatgccatgagggtctaagctagtttccctttgtgggcttgaagtctaaagagttaagcatgtacacctgttccccttcagcatcagctactgtgatcatctgaaccctgctgaaaaggttaagcctttctggtctcctttttttgtttgttttttgaggtagggtttctctatgtagccctaactgtcctggaactcgctctagagaccaggctggcctggaactcacagagatcctcctgcctctgcctcctgagtgctaggattaaaggtgtgcacgaccacccccagctcttttctaattttttaaagataacccaatatggtatagccatgaatgtgctgaatgattgattcacccaaataagcaggaggggaaagtggaaccctaggagccagggctggattgggaagtggactgcacccgctgaaaggcagtcctcagctacagggacaacactggacagggcctctcagctcagacacccacgcttctccagtctcagatttctaagaaatccctctagctggctgaggggtccccactacatgtactttccttatcacacagcaaggagaaaagcttgacaaggagcaggaaggatgaaggggagaaatttgtggggaatatggcccttatggtaaaaccatcttttggaacaatgactcaaaaataaaagtaaggcatgatagtacctgcctagaattccacacacatcctgtgatcttgtgaggcagcaggattgcaaaatccaagctagcctggactgtattatatctgtatccctacccctccctcacaaaaaacccaaaagtatcctctgcccaatcagcattcagtgaggtaacagttaacaactgtcactaggagagaaaacacactgcgaccctaggagggaagactacaacctgcactaataagggagtcctagctcactgaggctgggctcataacatgccagacatagtaagtgcttcacagacactagctcaatgaatctgtctaacaacccgagtaggtgggtactgatatatccccagtggaccggtgagaaaactggcagtagtgtcttgataacattctcatcaagacaattgctcaaggctcctgaaccacaaacaacaagaactgagatacatgggattaaattcagacttctttgattctgtgtacagtgtgtgactgctacttaagcacatctaatgctaagatgcagacccttccttgagaaagtgtcttactccacacccaatctgctgctaatcatcataatacagtatttctcttagtcctttccttaacccgggagaagcactggagtcaaaagagccaagtaactacgggcaagaacatgttaagccagggaccaggctcgggtttgaatccaggtctgtcacaaaaggacaccaaaacactcgggtgagcttactgggtggtacccagcagctgtcaagtggacttcctctctgaacccagcaggagggagctggagactggcctggccagccatccagctattgagagccatgccatctgagagccggccagccgctctccgcctagaacaagaatagccacgagaaactctcaagcccagatctcaagttgggtcttttttttggatgttagaacaaaacattaaaaagaaaagttttcttggaagtctgtttttcaatctggagaatgaaatctggctgcttctacaagacagtctgcccaactgctgcctctacatcagagcttcccagcagcctccaggagcctgtccagtttcctaagaggtggaatcagttcttgggctggaaagcacagacagacaaacaggtcagcagctggccctgggtcacagttttcccttctgggggtcagctcagggctgatgagaaaagagttggcacatgagtaagtcactgtgcccatgtaggacataacagaaacccacagagtaaacctcaaaaatatcaaaccaacgactgaatgttgactatgagcaacataaaaatacgattcttagctcaacaagatatgtttacatacttcagggctaaaccctgtgacactctgccatgctcatactcttgctcatgcaggatattcttttctaaggctagcctctttcttgacaccaggtttagtaaaattaaataattccattattgtcaccagagagtgatattatcatattttaatatgaggtcagactgcttaattgaattgatttaatttaagccgatttaggcgaagtttctgggcttcttggaggcccagtttccttctgtcaaaagtcagtgggcagaacaagggggcctatctgagagcttctgtgattataaccaatagattaaaggcctgtaaaatgcttagtaaagccaggtgtgatggcgcatgccttgagtcccagcaccagcacttgggaagcagaagaaggtggatctctgtaagttagaagccatcctactctacataatgagttctaggcccaccaatagtatataataaaactctttcaaaaaaaaaaaagcttaacaaaatgattgccatttaaaataacgcctcaatattcactattgttgtttccactgaattaaataatagggctcaaattatctttgaaaagcttcaccagttaaaactgtgtcacaaagtagaacgaaacctcaaccactggctcagaatctcttcattaaggagcccctcctctctaaggtagtcagtttcttaggggcaaaaagccacaaacaagattgcagaattaagcacaagataactgcggcctatgctcctcacacccgtgagcaaaccacataacacagcaggcatgttcattatgacaggcaagggacattaccagagcatgccagagacagcagatgccaaggtgtctgaccactcagatgcatctagcgatctagatctcagcggtaatgacatgaggtctacactctggcagtgcagggaggactgtccaagaagctgacgggcacagcatactgtgtaacataacaactcgctcacacagtcttcaagaaatgtcatcagcctccttttgttggggaagaatgacatttgccacatgtttaaggctctgtcctcaggactctttctgcaaagatctaaagtggcgtggccactttaaaggtataatcttaggaagtgacatataaattccctcattttattccaatccccactaactccttagaatccaaaccacaagaaagtcagtctattttacagatttttctaaatctattttacagatttttgcctccaaatctgttctttgttcactagccacactttggaactcctttggtttgattttaaaatgtaaacctagacaaaaaaaaggggggggggcacagcagaacaaacaagccataggtttgcttgcttgtttgtgagtagaacaggttttccttacgtttatggaaatcttcatgccctgtcttctaagtactggaattacaggcatgtgccaccatgcctacttacgctataggtttatgtggtggtttccgttcggaagaggctctctctatgtagtcttagttggctgggagctcgctatgtagaacaggctggcctgaactcagaaatctgcctgtctctgactcccaagtgccaccatgcccagcccatgccataggttttaataggcaaatgcctaaataagtcttagaaaatctgaagggagggtgtgatcatcagaaaactcactgccatttatcctaaaggacaaagcctgggcaaaacgcaccaagatgcacactgttgtgtctgtgaacatgagtttccaacactagcacaatatctcccaaagggaactctctctcatcaaaataaaacaaacccaaattattaagttgcattacaatttccagtttgtggttacattcattcacgggcagcatgctacagtgggaaaatccctgaggtttaagccagacaacacaggtgcaaggcttggctaggcaatcttgggcaagtcactgagcctctttaagcctcaactgtttctaaacacaaaacaaaaataaataatacaagcacttactataccacaagattgtgaaactcctaaaggagacaaacatgaaagcaaataaatgtgagctattaatacgcaattgtaactttttgaaacttttcttaagttggtaatctgcaagctatgactgaaatatgaaaattaactatgttataacagtccattttgatactataatattaataaaactcaagaaccttcactagggaactagagagatggctcagtggttaaaagcactggccgctcttgcagaggacccaggtttgattcccaacacccacatggcagctcacaactgtctgtttgggaactgtagttccagtgtttccaatgccctcttctggcctctgtgggcactgactgcacgtggtcggtacacatacacaccaaatattcatacatgtaaatgaaaactttaaaaacagaggaaccttcatcaatgagtgacgacaagcattcatctaaaataataataataaatataaatcaagtattaaatatctgatgataaacttttgttttttcttttgggtgtgcatgcatatgtgtgtgtgtgtgtgtgtgtgtgtgtgtgtgtatgtgtgtgttgtgtttatgtgtattgtataggcacatgagtgagcacacccatacatgtgcatgcctagtccagaggaaactatcaagtgtcttcctctgtctctctacctggaagagctcaccattttggctgaccggcaagctcccaggatctacaagctgtcatctcccctcccccaatgctgaggttacaggcacatctggatctgcgtccttgcatggctcaagggacttgacctgaattcgggtattgaaataataaagaaaagacaaatagatacatggacacagacaaaaatgctgattcagttggactggggtcttagatagagaaaccgtaacacccctgaggctgtatgaagtttattacatagatttgaacagacacagggttatagcaaacacctgaacaaggaggtggagtttaaggcatgagtggctaagtcatggtaggaatagtctctgtattggtgcagtcatcaagctgtcaatttctgtggggagaacgatatagtggacattttctacacacaaggtcaacacttacacttggacccctgaggagagctctaccactcctctgagcctcctcatcccgaaaggctttgtcatcttcccatcagtctgaggatctgaggtccttaacatggccacgcccacgtcaacaacacaaattcactgaggacgtcactcactcccgacatggggccatgtacagcttcttccatggggtgcagatgcaaactcgggcctttatgcttgcacagcaagagatcttactccctagccttgaggataatgtttctatgggaaaagatacgatggtaggctggagaccttagcattgctctcaggctctcgtgtgtaagatccccaaattgcaaacaaacgtaaacaagcataaggtggatatgttggttttgcttgtttgtttttcagattatttacttttttattttataggtatgggtgtcttgcctgcatgtatgtctgtgtatcacatacatgccacattcacagagtccagaagagggcatcagatcctctggaattggagtgacaaatgatcatgagccatcatgtgggtgctgaaaatcaaacttaggtcttctggaagaacagcaagcgctcctaatttctgagtcatttcatgggctccagatataattattcaattgtttgtttggctttgggggggttgtttttaatgttactttctaaattaagtcatactaaaaaatcaagtaaactaaagcaaaataaaaaggtcaagggaaatgcacatggaattaagaaaaaactcaatattttctatatcatttgaagaaagcatattttctcattgtggattaattgcttgtataataagaaacagtttaggactggcaaatggctcagtaggtaaggatgtttgccaccaagcctgacaacctgattatgattccctagaatccgaatggcagagagaaacctttataagttgttctctgactctacatggtccccatgatgtgtatatgctttcacacatgtgcatacatgcacacatacactcatacacacactaaatgtctttttttaaataaatgtctttttaattaataaaaaactccttgtttacaaaggagcaaggaaatgatccttcctgatgaacaagaaaatagaaagtaaaaaagtaaattagaattataactcaatatagtattttaaatccctaatattaatctgctgaaatagtgaagtagccaaaacaactgatatttgagttttaaacaacccaaatagttattaagcaatcaaaactgcatctagccttgttaactatgtacagacatttgttgccagaggaaagcaccagctgtacaaacttgttaggtgcctagctctttaaggggatggctgctactgtaagtgcacagagtacaggtttccttttaacgtctgtggacacagaatggcttacatttattttccagtgaccttacaaacacctattttagttaaccattttaataattatagtttacagtaacatccttctggaaagcaatttatcgataggatgttagtattaaaattatataagcctttgagaccaataacccgctaataaaaagaagaatcattgttgcagaacatttgtacactgtgtgaagatgtgttagttgctatgactggtgtaaaacagatgaatggccaatagctaggcaggagaggcaggtgggacttcccagcagagagagaagagataatcaaggcagcatgctgaatgaatcggacacacaaaatgggagagaggtaaaatccacaaggtagaacatagattaataaaaatatggattaatttaagttataagagctagtgggttaagcctaagttaatggccaagctttcctaattagcaggtaagttggcagcccaaaggaaagtctaactacaaatcatgacatttatttcaggattaactaaaacaatcagaaactagacacaaaaagagcaatgactgacaaaaaaagtccatgtcaaatgctaagagagggcatggaggcacaagcctgtaaacccagccagcacttgggagacagacagtaggatcaggagttcaaggtcacccccagctgcacagcaagttcaagggctggagaggtggctcagtctatgaaatgcttggcatgcaaacatgatgacctcagcctgatccctagcacccatgtaaaaatacaggtcatgtagcaggcatagtggcctgtgcctgtaacccccctgatggggagacagagacaggagggtcactggagttcactagtcatcaagtgtagcctaactgtgagctccaggccaatgaaagaccctgtctcaaaggaggtagacagtgttttggaggaaaacaccacggtgaacctctgagctatatacatgcatggataaacaggtataacatatacacaaaaaacaaaggtttaaaaaaacttaaaacccacagccacaaaaataaacagtggaccgtttcctttcagaacaattgagagtcacttactctgaaagaattcctcaaagtcagttttctccacacagctcgtgtacatgcgtagggctgcgatcttaatcttctagacaaaaagaataaaaccaaactcaagacatgaccaagaggatgttctagagtcattaggtatggactgcagagctcatgtttcttcagctagaaggaggggtgtaaacctatctttggcgatgtattttgttttgctttagagaccggcccgcaagcagcccttgttgactggggatgggctctgtagttcagcttaccatctctacctttaaaaataaacataaatttttaaaatgtgaaccccgaaatcctttaatctttgctcagaggctctactaattagtctgtgatttggggggtggggtatgtcttttctacagactcacagaacatatgtgcataaacaaaattctctaataaatatggaatacttctcactatgcctcaagtactaaatatgaagaacttagtatgcagtactacatcttaagatcaaatctaaaaattataaatcaattctgacagagttgagttggtctgaagaacaaaccagtaaaacaaaattgaaaaactaaaccagtatataaactaaaaccagtatataaacaaaagacttgtataagtttctttttctttcttaaaattacagagcaagctgaacatagtggcccatgcctatgatcccagcactcaaagagttcaagaccagtatagtctacagggcaggttccaggccagtccagactatagtatagtatagatttttttgtctcaaaaacaaagcaaaacaaacaaacaaaaaaataaactaaagtccggtgttgatggcgcacacctttaatcccagcactcaggaggcagaggcaggcagatctctgtgagttcgaggccagcctgttctccagagcgagtgccaggacagcctccaaagctacacagagaaaccccgtctcgaaaaaccaaaaataaataaataaataaataaataaataaataaataaactaaaaacaggggctggatagatggctcagcaattaagagcactggctattcttgtagagaacccaggttcagttcccagcaaccacatggtggctcaaaaccacctgtaactccaattccaggggatccaatgtcttcttctggcctccacagacaccaagcacacaagtggtgcacagatacacaagcatacatacaggcagataaaatacttatatacataataaaaataaataactgaaacaaaagcaaaacaaaaagaaacattaaacaaaaggtatgatggctcatgcctcaaagtccagcacttaggaggctgagatgaatcagaagctcaagcttcatctacaagatctatctccaaaataaataaataaaaacaaataaatagagcccatcaagagttaagatataatacatcacaatcaaagagatttatgcataaatgcaaagttgaacccaacactggccaatcaaagaagggatgagagaaggagctgcctgtcaaaattcatcaagaactgcgattcagctaagcatgatggtgcatgcctttaatcccagcacttgggaggcagaagcaggaagatctctgcgagttcaaggccagcctggtctatagatcaagacccaggacagttcggggtatacacacaaacgctgcctcgaaaaactaaaacaaacaaaaaacaagaacacttaaccaggaaagtacaggtttaggaaagcactgagctacactattgctggcctagtgacaccctcatcctgacactttggactccagcagcccttctgtccttgagatgggaactttaggctcactcaacactgcataccaaatggagttcctgccacagatctaaatgctatggtgagggataaacaaaatgaacaagtatttctgccctggttgagtgtatggcccaggttaactataaacaaatttataattttaactaaaattcctagttacttaattcttgaccctccctaccatgcttgtagtttccttctggatcctctgcataaactcttcttaggtcacaactcatcactctgccctgggaaaggcagacttgtctccaaggcccagggctccaaatacatccatgaaaaagtattcattacaaatagtaactacttgaccagactggccagcatttttatacagtgctcacactgtggcaatcagaaacattttatagttcttcaattttcttgaaccaaagccaaacctttattcttgggtgagccattttcctggacaaatctctgaagcaagtccctgaggactatcactcagggactggaagtaacagctggaaagaatctctttgagaaccatgagttaacgtgagtgaagggaaggaggcagactgaatttccactcagtcaacacaagctgttccagtcctgggatgacttcatgtttatttcactctcactttgggagacttcacaggacacctaggcctactctcccacctgcctggacatgcgtaccctccaacaagatgaggggtgaatggggtaagaggattgtagtaacggctgggtaagagagagctgcacaggaaatttttctttttttttttttttttgtcgtcatttgaacttcctattctgtgctggaattttttttacaacattcttatttcgtgtttaataatctgagcccctattccaacaagaacaagctcggaagctcccgtcctcctggagggctctcatcatccactactctgagcacctcaggtgtcacgtcttccttcattcatcgttgatttgtccctcaatactaagagaactcacaatgccttctcttttctataccaagcatctctatttctttcaattattcttttttctattttgggggtgggattggggggaggttttctgtgtcccccctaactagcccaaaactgtttcacagagatctgcctgtctctgccacccaaatgctaggattaaagccctatggcaccattcatggttttcttcaaccattctttagttcttacacgatactgctatttaaacagaagagggggaagggtgacttctgagtggagcatggtggtgcacatcaataattattttcaacacttgagaatcagaggcaggcagatctttgtgaatttgagttcagcctggtctacatagctagttccaggccagccaaggctacacagagagaccctgtctcaaacaaaacaaaacaatcaaataaacacagaaaaatgctattttaggttgctcaaataagtaagaaaaggctacacttaaaatcttaaatataggctagggacattgttttatggtctatgattgactagcatgagaaagtcctcaagctagatccgcagcaataaagtctaaatgtgaatctataggaacctatacatgaaaacatccaagaaaaatatagccaaaaggtaagtcataagcatcagtagacaagtaaacactttgttctctaagcaaattcttgtgaaaataaaaacaaggaattttgccagtgcaagccaatgcaagtatctggccacagatttctgagttaacagtgctaaaaaggatttacctataaacctttaaaatggaaagtcctcactacattttcccaccaaaatcataccagaatgtgtcatactgtgatattttgatgtgatagattttaaaatgaaggctataaaaactgccacatcataaaagattttttttaatgtaaatatttagttgaggtaacaaagggaatcaagaaaactcagaggctaactcagctataagagagaattctcccactggtctcataatccttcaaatggtggccaatttgccctgaggaaactttaaaaaacaaaacaaaaacataagactagacaaagcatatggaagcaaccaagtggaacccaattactaagacatgagtaaaacagttaattttctcctctattctttctttatttccatttcacttttccttttttggggggaggggagtgggcagggtagcacacgcctttattcccagtagttggcagagggaggtggatctctgtgagtttcaggccattcttgtctagaattcacaaagatccatttaggattaaaggcatgttcaccactcgtaatttttaatttctactttttaaacagcagacatattttaacttttatattacaaatgtcataatcacaacttcttttttttttgtttgtttgtttgttttcaagactgggtttctctgtagcttcggagtctgtcagtagaccagactggcctcgaactcacagagaccacctgcctctgcctcctgagtgctgattaaaggtgtgtgtcaccaccacccggcacagcttctttttaaatacagggaagggccaacaagatggctcagagaataaaggcttttgccaccaagcttgatgatataaattcaacgcccaggatccacatggtggaaggagagaacagagttcccaaactgtcttatgacctccatacattctccaaggcaagcatgtggctacatacatatacacatgctcacttgtgctctctctctctctctctctctctctctctctctctctcttgcgcgcgcgcacacacacacacacacacacacacacacacacacacacacacactaaataaacataatcttaaaaattataaatgggccggaagtggtagtgcacacctttaatcccagcacttgggaggcagaggcaggcagatctctgagtttgagaccagcctggtctacagagctagttccaagacagccaggattacacagagaaaccctgtctagaaaaacaaacaaataaaaacaaaaatatatggaggaaaatctagtcatgatagtttacacctataatcctaacacttgggaagctgaggcataggactgctacaagttctagaacaggctgggctatagtatgatgccatgtttcaaaagaaaaaaaaaaactaaaatttaaaacagggagaaaaggtctggtcagtaatcaaatatatcaattcatcacctgtcaagaattttacaaacataaatataaaactttaataaaaataactaattccagtggtaaggaaagctaaggttggaatgtaaaatgaaacttaaaaaatttatttaaaaaaaggaaagaaaataactatttccttgaagttttagcagagactgcagggtctctaagaatatcactgtcacttagcatttgtagcctctccatatatttgaaaacaaagttgaaatcaatgttgacttttcagaatttgtatataaaagcttgcagacagaaacctgtatttgctgtcatgaaaactgttgggaaaatgaactaacctaagaaagcaagagtagtcaggcagtgctgcgtgcctataattccaatgtgttggggaacagatgcaggaagatctctgtgagtttgaggccagcctggtctagcagagtgcgttctaggacagccagggctacacagagaaatcttgtctttaaaaaaaaaaagattttgacccattgcaatgtccctttaaactcatctagatgctgttttcaggcaataaaacaagggcctgaaaactttgcctagttgccctgcaagcaactgcagacacttccaaggcattgggctgaaggagtacttcgttcttatctatacataaatctgactagagtagaggggtgcattctgaagaaattctcaaaagaatgtatgaatttctcaaatcagaagtaaatctatgatcaacagaagggcatagacccaaaggaacataaaatctttacccatttactgtatttcaaaggtccagtgaatcccatggcttctattatcttcgtgaagggaccgaccttctcctcaacaggctttgggaaatcttggatagtaggaagctacttaaccaaagaaaaagaaatcaagttagttacaagaaatttcctaaacagagtgcttttatttcttccttctaagaacatttttattgcttagatttttttcactttgatttcctttttttctacttgcttgctttgactgttctgttctgttttagtacagtgctggagatcaaacccaggttttcacaaacactgggcaagtgctctctcatggagccagactcagagccctcacttaggtgtacaaacacatctgaaatggtatctaacagacatcctccaaattacaaagcaaagcatacccacctaagtaaccatgtgcctgtgatcccatgattaggaaagaagagactagaggtactagaataaaggtgacatgaaaaagagagagatggctcagtggctaacagtactggctgctcttccagaggacttaggttcaattcccagcaaccacattgcagccaacaactgtctataaccctagttctaagggatctgatgcccacttctggcctctgagggcaccaagtgcaagcctggtgcacagacatacaggcaggcaaaacacataaaaaaatagaggggaaagggcaaggagtgggcagaagggagtgaaggaaaaagagtaagggggagaaaaaggaggaaggaagagaggaacgggggggggggggggggggggggggggttggaaaaacacaggccctgcctagaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtagataattcagtcagtaagaaattcttgtaagatttatgactgtgttaaacttgtacaaactccataataattattttcctctaaaacaattattaatttctagacaaagagcctgcagtagaagaaacaagctcacaagataggcttcacatagtcaatgagtttgtcactcaccatcctctgtaaacttgggtaaatccctccaactccccgaacctcaccttctatattcacgtaaggcatccacataaggcagtctacagtggacacactcaccttacttgtggtgtggtatttcctattctgctgtgtgtccatcccaacactttgttctaattccacccatactcgagactggttcatctgtggcctctggaggatgaacagacagatatgagtgacactgagcatgacttatcaaagttagcccaagaagagctctctggctggctctacccaaccttgcttgcccaacttctggcgaaagaccatcgatcgaaaggagccaagatcagcagccagagtggtgtctggtacatggcaggtgcttaacaagtatctattatgtaatggctcacacttgcaatctctggaaggctgaaacaggaggattgctgtgagttcagtaccagctcagagcatagttgagagatggttccaaagaacaaaatgaagtccaaaaattaattcggtatagactgaagtcaactcagagaagtaaaattataataggaaaatgaaagagtactgcaatgagtttctatgtaaatgctgacaatgtctgatgtgtaagagagggggcatcaattttaagattaaaacttgttactgctggtaggcaaatttctgtacgtttgaggctagcctggtctgcagaacaaattccaggacagctagagctatgccaagaaactctgtctcaaaaaaaaaaaaacacatttggggcagccaggtagtggtggggcacacctttaattccagcacttgggaggcagaggcaggcagatctctgtgagttcaaggacagccagggctacagagagaaaccctgtctcaaaaaacaaaaacaaaaaatgacaacaaaaaaacttggataatatctctcaatgtcaatggtcttaacttacccataaaaatatataggctaacagaattacagagagaaaccctgtctcaaaaaacaaaaacaaaaaatgacaacaaaaaaacttggggttaaagagatggctgctcttccagaggatccaggttcagttctcagcacccacatggtaactcacagctccagaaaatccaacagcctcacacagacatacatgcagacaacacaccaaaataaattaaaaaataaaacaatataaaaatttttaaactgcttctgccacctaaaagctcaggggccattgacaacttgctgcacgtcagttacagtgaggcctgaaggggaaaagcatggaaaatgcatctcacatgaaaaacacaattttttactttttttattttaaaaacataagtaaaattacaaacaaaattatgaatgtgtgtgggtgaatctaggaagcaacacacagaaatgaaagggttatttggttaaattggaattgtaggtagcaagttaggaatgtaactcaatagtagaaccctttgcctaacatggacaagaccttgagtctgagttcctgtaccacaaggagggaaagaaagaatgaattatgggtaaatttgggaactcagtgtccaaattcccagcaatgttttaattgccataaattaattaaaagaggggtgtagtgggtgagagctgggcatggaggcacatgtttttaatttaatcccagcactcaggagacagacacagggggacctatgagtttgaggccagcctggtctacatagtgagttctacccagcacagtctcaaaaaaataaaataaattaaaataaaataaaataaaataaaaacaaatatgggagggtgtagagggttaatcctacaattctggtttattccaaaaagaggaaggctaaatggaattaacaatgatttagttgtttcatcttaataaaggaaaaatagtttctcattgtggactagtactatttgtatttctttccaaacaaggatattaaaagattagtcagaactcgtctgcaggcccagggacacttatgctttaattctcaagtaccaagcaggctttgtgaaatacagactaaacacagaacacctcccatgacatcacacacatcagtgtaatggcccatctagaacacaaagcacttcagctgcctccaagaatgcaaagtggagcctgaacagagtgctgcctcctcctgtgttggtgttcgctgagacatctttctctgtccccacaggtccacagtggtcacagattccttctactgtacactgtgaagcaccagggcaccaccactttcccactctcctgctcatctataaacacacatttactttggggaccaccctccttgcctttgcctacttcaaaaggggcctgggagcccctcaatttttcatctttttcaagctgaagagactgcccaaaataactcaaatattactttttcaaagagaccttctctctcttcttttggtttttgttttctggttggtttccttttgttttgagactgggtctcatgtcgtctaggctagccctgaacttgctatgtagctgaggataatcctgactctccagcttctacctcccgcttctgaaatgacaggcatgccctgcagtgtccaacttcatgtggtgctggggaccaaacacgctagaccagcaccaactgagctacacccagccctcaaagaggccctccctaactaccttataaagcacagttctttacaacccattatctccaccaaaacgtagcctattcacttcctccatggtactagttaaatgcataattatacatttacttaagtatttgcttattagccgggcgttggtggcgcacgcctttaatcccagcactcgggaggcagaggcaggccaatctctgtgagttcgaggccagcctggtgtccagatcaagtaccaggataggctccaaagctacacagggaaacactgtctcggaaaaaaaaaaaaaaaaaaaaagtatttgcttattttccagcaccactgtcaaatacatacatgatggtaagaacagcctctctcatcagaatggactccaatatggcacacaggagacacgtaagcagttgctgacaaagcaaatcctccatttccataatatttgattccccacccctaccatctttgaccacatatacaccatagatacatgcttcatttatccaagctctactaaatgctcaagatatgccagccctcatacaggcttgagggtagaaataaatctgtatcctctgggagctcatggtcttacaaagaaaagaaaacaaaagagaatttaacatagaaaaccagaactaagtgccacactggaaatgtcactcccagaagtaaaacactccagtgtcaggaaggatggagagcctccagaacactgacacactgcttgtgtgcagacaaagtaaatgcgccacttggaaatgtatttggtagtgtctagttaagatgaatgcccagcaagtaaggctcgggaattctacattcttacctcaacagaagtgtatgcgtgcactcgcagtagcagtgtcatgtaaggttccgagtagacacaacccaaacaaccatcagcaggagagcttgatgaatcaaggcatagccatataatgaaatactgtggactcaagccccaggaccaaaaaagtcaatactatggtgagaattagtcaaccaccactacaaagaacagatttattaaatctcccaaacaaggctgaatgacagcaaacacaagagactgcttgacagatgtttaaaaggcaaatgaatctacagaacatgaggtaaagatttgctaaccttggtgtggatagtagctaacgggggatcgaagagacttcggcaatctttttgtttgttttgttttgttttgttttgtttttcaagacagggtttctctgtgtaacagtcctagctagctgtcctagaatttgttttgtagaccaggctggcctggaactcacagaaatctgcctttttgcctcccgagtgccaggattaaaggcatgtgccaccactactcggtgagacttttgcgatcttagtaatgtgctttgttttgttgtaagacagagtttcatgtagcccaggctggcctcaaatgctctacgtagctgaggataaccttctgctcctcctacttccactttccacgtgctaggactgccagcatggacaccacagctggtttatgtgccactgtgaattgaacacagagttccacaaatgttaggcaagtcctccaccagatgactacagcctcttgttctactcttgacctggatgctaggaatgtttactctgtaataattcattgagttgtgatttgtgcctttttctccatttatcttatatcccaataaaaacaccccaaaatttgggctggggagatggctcagagattaggagcactggctgctcttctagaggtcctgagttcaattcccagcaaccacatagtggctcacaaccatctgtaacaagatctggtgccctctttcagtgtgtagacatgcaggcaaaacactatacataataaataaatgtttaaaaaaaaaaaaccaaaatcattaagatttggaataggcaagataaacaacagaaaacaatgacctggaatcaccagaaaatcctcctagaagaggacggagcagagaagtgagagggcagctgagggacccgaatgcagtgaaagaagacacgggctgaacctcctgctctctcacaagggttctgagaaccagaaacaaattacatatgcaaaagagatgtgcaaactgcgatgagtaatatatgctataaacatataggtctagccaggtggtggcggcgcacgccattaaccccagcactcaggaggcagaggcaggcggatctctgtgagttggaggtcagcctggtctacagggtgagttccaggacagcagtgctacaaagtaaaccttgtctcaaaaaaaagtatgtatgtatgtatgtatgtatgtatgtatgtatgtatgtataagtgtatatgcacatatgtacgcacatatgtgaataagtaaataaaaagagtaagatttcacacaacaggaaagcaggaaggctcagtgggcacaggcccttacacacaagccaagttcaaaatacggatcctacaatgtggcatgagtaaacttctgagagatgtcctctgactttcccatgagtaccatggcatatgtaccctgaactcacacacacataataaaataaatgaaatctgaaaaacaatttcacacttatttttcgtttcaaaaagtttgagggccggagatgctggcctccatcctcagccctagacaaagctggtgcagtggtgtaggcctgtaatgccggcactcagagaaggtggaggcaggcatagcagcagttgaaggtcatcctcacctagatggttaacttaagaccagtctgggatatacgagtcaacaaataataaggaaatagttaaaacaacaaccagcaaaaggtcttgaaggtgaagaggctcccatggtggggaggagtgggacagagacaggctcaaacagttcttgaatgctgagagtgtgtgtatctcacagtccaccagggcacagcccacttaacactccttttattctctgcaccagtgctcaacaccattctgggcatggaatcagtactcaataaacactaggtagatttttgttcaaagagaaggacaacctggaggaggtccaaaaaagaaccacagcctgatcaaagggaggaataaaaggtcctcctggtggaaaggttaaaatgaactgaagttgtttagcttggagaaaaggcaactgaagaattaaggagtaacttagaataacactggggctggaagacattgcagaggtctcccagtccaattttttcacttcatagatgaggagactaaaaccaagggagaggttgcaacttggggaaggtaggttaggataatatttttttttatttgtgttttatagtgaggactaaatttactcaagcagtatgagcttatatagtaataaaaatagcagttacaaaactgggtgtggtgtcatatgcctctaatcccagcacaggaagaggcaggtggagctctgagttgaaggttagcctggtctataaagaaagtccctatctcaattaataaatcctcagtcaataaatgtaagactggcagaaagaggaaatcaacagtagggaagatgactgtaatgattattagtcaagaaccatcaagagaattatgatatcattcagcaatccaaattggacatacatccaagagtagggtctcagggagatctttgcacaccaatgtctactataacattattcattattcacaacaaacaagatgaatccacccaaacatccaaagaatttcatggattaaaaataaatatatacttgagtggtggtggcgcacgcctttaatcccagcactcgggagacagaggcaggcggatctctgtgagtttgagaccaccctggtctccagagcaagtgccagttcagcttccaaagctacacagagaaaccctgcctcaacccccccccccaaaaaaatacagtatattatgcaacagaagattagggtagccctcacaagaagaaatcttattacatgccacatatgcatgaacatagaagatcttaagctaagtgaaaaaaagcgagttgactgcacttacattcaacaattagggtgatcaactccccgttaaaaataaggaaaaaggggctggagagatggcttagaggttaagagcactggctgctctttcagaagtcctgagttcaaatcccaggaaccgcatggtgactcacaaccatctgtaatgaaatctggtgctctcttctggcctgcaggcagaacactgtatacataataaataaataaacctttaagaaaaaaataaggaaaaagttcgctgggtatgttgatgcaccccttgatcccagtactgggaggcagaggcagaggcaggaggtgctctgaattcaaggctagcctggtctacagagctagatctggacagccaggactatatagagggaaaaaaagacatactaagaaaattagaggtctggagagatggctcagaggttaagagcactgattgctcttccaggggtcctgagttcaatttctagcaaccacatggtggctcacaagcatctacaattcaatctggtgccctattctggcatgtaagcatgcagaacactctatatataataaataaattaaaaaaaaagaaaattagagcctataatgccaaaaaaggacataatttacaattactatttcaatgcaaataaaggctatctaaacattaatatcgtctgttctagtaagtgaaaaaacaccaagatatataattctatatatatttgatatttgttaaagtacttaactatttgtttcagtgctggagactgaagccagatcctcacgcatgcaaggaactgagctataccccaaccctgtcaggatacttaagggaaaaattaatatgcacaaatttccataaagcctggaagagaaccagcagagatgaaaatattgacattttcagatttgaagtcacagatgattttatttcctttaatactaaagtattatatgactaagcaggacagaggtggctcacgactttaatcccaatacttggaagtcagaggcaggtggatttctgtaagttttaggtcagcctggttacacagagccatatctcaaaaaacaaacaaaaaaaggtgttatatgacttataaaaattaagaaatcaaaacccattaaagagcccaaggttcaagacatcaaaataaaccatgtggtcaatggtaaactaaggccttcgataatcgtgtcttggattttatgttcataaagaaaaggaaatattttgctacccaaagaaaagtagcacaaaataatttttaaaagaaaactgaaagttaactctaagatgaatatctggaaaaggtgcctaacactaaaaattatcagacatggtatccctggctaagttccacttagcaggggtattaagaagcgacaccctggacatgacaccacagagacccacagtgatctcatggggctttttcatcacacgatgtggtttggacataaaaaaggtttcatagcaaccaaaagaacaaactttacctgggaagtgctggagagagtcctgtcccactgtctttgagtaggagacaccgataccagttggctgcatattggaacccactgagagatgttagtctggttcctctagaaaagaaaaacaatgtcaggaagccatcagagtccatatgtagagagtagagtgtacctgcaatgttgtaaaacagtaagaattacagatttggttggggtggtggcacacacctttgatccctccatttgggagacagaagtggaggaccttttaaggtcagcctgagctacatagtgagaccttttttcaaagggggttgggggagaagaaatacatattcagccttcaagtttggctcctggcaagagttcctaaaccttctggcattcagacatgagtgttttttctttcataacaaccactttcaaacttaagcgtttatgctaatgacttgactctacaaacagaggacttggttgggtaaaggaactaatcgccagagtgccactgagtgacctaagtgttctgttactaccctactcatacaaagagtatgtgtatcaacaactttccaacatcacaaagttagtaaatggcagctttaggattaatactggaacccagatagctatctccagaacctgtgcacatttaagagatcaagagaacagtttaccttgagggtccttctaattctaatactggaggtagagccattagcagagttttgaaccaattaaaacagcatattggaggttagggggaagggctggagagacaactcaagtggttaagagcactggctgtcaaacacatctgggggttgattcccagcacccacatggtagctcaacagtctgtaactccagttccaggggattcaatgccctcttctggcctccgctggcacttggactcacccgtgtacatacacataatatttaatgtgtatttaaaaaaatgaatcttaaaaaaaaaaaaacaccatatttggagctggcactatgacttggtgccttgcctaccaagtttgatgtcctggacccatacagtggaagcagaaccaactcctgctggtattctttggaccactacaccatggcacacatgagcatgtgcacaaacatgaaaataagtaaataaataaataatgtaataaggtctagagtcatcttttaaaaattaaaattaaaaaagaaaaaaaaaaagtcaagcattgatggggcatgcctttaaaaccaacactggggaggtagaggaaggcggatctcttgtgatttcaaggccagcctggtctacagagcaagtaccaggacagccagggttacacagaacaaaccctatcttgaaaaacaatcaaatcaggggctagagagatggctcagaggttaagagaactggctgctcttccagaggtcctgagttcagttcccagaaaccacatgatggtacacaactgtctataataagacctaaggccctcttcttgcttgcaggtatacatggcagccagaacactgtatatataataaaagtcttttaaaaagaaagaagaacaatcaataaataaaacagaataacagccgggcagtggtggcacacgcctttagtcccagcactttggaggcagaggcaggtggatctctgtgagttcgagaccagcctggtctacaagagctacttccagggcagcctccaaagccacagagaaaccctgtctcaaatagtttattgtgggccagcatgatagttcaatgagtggacagatgaccagagtttgatcctcagatcccacaaggtgacaggagagaaccaattctcaagacctaacacatgaatgacactgtagcacatgtctgcactcacacacacacatatacccataacaaatagcacatgtggaatgaactgtgtacttgcttcttcagaggtcctgagttcaattcccagcaaccacatggtagctcacaaccatctacaatgtgttccagtgccctcttcttgcctgcagtgcaggcataaatgtaggcagaacactgtatatattataaataaatcttaaaagaaaaaaaaagacaaataagaaattccaggactgagaatggataaagaaaatgtggtatatttacacaatggagtactactcagcagtaagaaacaatgacatcctaagccgggtgttggtggcgcacgcctttaatcccagcactcgggaggcagaagcagactgatctctctgagttcgagaccagcctggtctacaagagctagatccagggcagcctccaagagccacagacaaaccctgtctcgaaaaaccaaaaaaaaagaaagaaagaaacaatgacatcctaattcccaggcaaatagacagaactagaaaaaaacatcctaagtgaggtaacacaaaaccagaaagacaaatatagtatgtactcactcataagtggataccagacataaagcaaaaggtacccattctacaatccataaccccaatgggctaagctcctggagtacaatcaaagtgagggaggagccataatatgaacaaaggagtcaagaccatgatggggaaacccacagaatcagctgacccgagctagtgagagatcactgactcagatctgacaaatggggagcctacagaagaccgaaataaactctcttaatgtaggagacagtggtgtgactgggacagtatatgaggccactagcagtgggcccaagatctaactgtaatgcacaactgacttaatggagcccattctctatggagagataccttgcccagcctagacacaggggtgtgggggtggagaggtaccttggtcctgcctcaacaagatgatgggacagacttagtcgacttcgtaagggaggccttaccctctccgaggaacaaatgggaggtggggaagtggggggagccggaagagagggagggagggggaactgggaatggaatgtgaaagataaattaataaaaaatgcaaaaaaaaaaaagaaattctagggcgggggtgtagctcagttggtagagtgctttgcctagtgtgtacaaagtatgagggtgcacgcctgtaatcccaacacttaggaagcagaagcaggagaatcagaaattcacaatcatccttgtctatatagtgggtttagaccaccctgggctacatgagactgcctaaaaaataattttaaaaaaatttaagctggaattgaaatgtacaataacaaaaatgaaaaatggcatgcctcaatagcagatttgagcacaaagaactgataaccctgaagatacctcagtggagattatccagtctagggaacagaaagagaccaatgggatactatcaaacttgccaaatatgtataacatcaggattcttaaggaaaggaaataaagggacaggaaaaaatttaaaacaaaaccatactaactaacagaaggcatcagggaagggctggaagagatggctcagcagttctcaaggacctgggtttattcccagcatccacatgatagttcacaaccattcataactccagttctaactcttttctggcctctagaggcactgcacacatataatccatagccacacatttcaggcaaacactcagatacataaagtaaaagtcaataaaatctacacacacacaaacacagcagaagatatccccaaatttgttctacaatctaagaaattcaacaagcttcaagtaggataaacaaaaagatacatcataatcaaattgtcaaaagagaaagaggaaaacataaagaaaaaaaattgttgataaactgggcagtagtggggcacacctttgatcccagcactgggaaggtctatagagtgagttccaggacaggctccaaaagctacacagagaaaccctgcttcaaaaaaccaaacaaacaaacaaaaaaccattattgacagcagcaagagagaagcagctcatcacacacaaggagcccttagtaacactgaactaatttatcctcaaaaattgcagcagccaaaaagctatgggaagaattcctcaaaatgttaaatgaaaaaaaatgttacagcctgaccatattgggacataacctgtaatcccaatactcaggtgcctaaggaagaaggacaatggcaagtatgaggctagtctaagttacagtgggaccattccttaaaaaagaaagagaatagaaccagtaagtaaaatttctatatccagcaaaactatcattcaaaagcaaaatggaaggtaaagcaaaaaattcccagataaacaaaaactgagaatttgtagaccaccaaatctccaaaaaatattccttcagaatgaaacaaaaggatgctagatgggctgacaatttggctcaatggttaattaaaagcacttgttgctcttgcagagaacctgggttcaattcccaacacccacatggcggctcatggctggctgtaatcttggtctcaggagacccaacatcatcttctgagctcagtgggtacaaagcatacatgtggtgtccatatacaggtggtgcacatatacacatgcaggtaaatacataaaataataaaacggggatgctaaacagtatttcaaatctatatgaggaaataaaatacactggggtaaagttaactacttaagtaaataaaaatagatttattattattattatttttaggtctctgggagggtcttttttttgcaggggatgaggcaggattcctctgtgtaagccctggctgtcctggaatttgctctgtagaccatgctggcctcaaactcagaaatctgtctgcctctgccttccaagtgctgggactaaggttaaaggcatgcactgctgatgacctggttttatgcctcaattttttaatttaaaagttaatataaaagacaactataagcctgttgatatacatataggaagctgtgatctgaatgacagtggaatcaaaaaacaggaaatagaatagttatatagaagcatagttcttatatctctgaaatcaagctggtaccaactcaaactaaatcatcataaattagggtgctaattgtatttccaatataatcacaaaaactttcttcctccccctaaaaaatgccataaaaccttttaccatgggctaggtcttatgagtggcagtgcatctgcctagcttggcaaggcatttaaagccagcctcagctacataaagtccaaggtcagaccgacctgcttgagactgtctgaaaaaacaaacagatcaggtatctgtttaatcccagcaattcgaaggcagaggcaggcagatccctgtaactttgaagtcaacctgaacaacatgagttccaggacaaccagggctataaagagagaccccatctcaaaaaaaaaaaaaaaaaaaaaaaaaaaaaaaaaaaaaaaaaaaaaaaaaaaagacagaaggatcaatgcaagttcaaggctacaaagtgagacctcaacccacacccaaaagatcaaatagcttggtcatttctccaaagatacagaaatgacgaatatagaagttcaacatcactagtcactagagacatgcagatttttaaaaagcacatattgtctcatttccattagaataactaacatccaaaaacaaaaactaagctgtagagaagcttaatttttttttgcatataggtggtacagatataaaacagcacatcagctgtccagttcccagcttccacatcatgtagctcagaccacttgtaactccagttccagaggatcacacacacacacactttttttttttttttttttttttcccccgagacagggtttctctgtggcactagctcttgtagaccaggctggtctcgaactcacagagatccacctccctctgcctcccgagtgctgggattaaaggcgtgcgccaccaacgcccggctacacttttttttttttaaacagacttaattcgatttatttttcttgtataaaaatccttatgtggtgtggactttcacaagatggtcagtgaattcctgataaggagacttggtgaacacagtctctttccagaggtctgaagtcaggtagctgtaggtcttggagatggcatcaaaggtggccttggcaaagttgcccagggtggcagtgcagccccctggatgatgtgtagcggtcatcaataccggccatcatcagtagctttggggcacaggagcagagacgatgtcagtgcctctgggggcagggatgagacgcaccaacacagagccacatcggcctgtcactttgcatggaacagatacacacactcttaaacattaaattaaagaaaaaaaaacttaatgctgggccttggaagcaaatgcctttaataccagcactggggaggcagaggcaggaggatctctgtgagttagaggccagcctgatctacaaagtgagttccaggacaggctccaaagctacacagagaaaccctgtcttgaaaaaaacccaaaaagaaaaaagaaagaaagaaagaaagaaagaaagaaagaaagaagcttaaatataggggtgtaaccctgttgatagagcgcttgcatgcacaaaaccccaggttctactcctaccaccacatagacttagtggagcaggccagtaatcccagcactggagagatggaggatcacacccaagttcaagtccagcctagggtacttaaaacactgtctcaaaagagaggaggaagaaaccatcacagtttttattagttgaccctctgatcaaacctaacaacatcactgattaaaaaaaaaaaaaatctggggtcagtgagatggctcacggagaaaaggcaaccagatggtggcctgatttcagccccaggacccacaaggtaggagaaaatacccacaagttgtcatttgacctccacattcaatgtacacgcccaggcatgtacatacccacacacataaatatatcagatctctgagttcaaggttaacctggtctaaaggcacagtgcaggacagccaaagctacacagagaaacccagcctcgaaacacaaaaaaagacacagacagacagaaagaaggaggaagggagagagagagagagagagagagagagagagagagagttgaggggctgagcaatggttgtgcatgactttaatcccagcagcactggagaggcagaggcagatggatctctgagtttgaggccagcctggtctacagagcgagttccagggcagccaaagctacacacacacacacacacacacacacacacacacacacacacacacacacacggggagctctgaagctcagagaagtcagttggttactcaagactccacctacagcaggtggtggagccacaatttccccatgactgtccagatcctagagaggttcacaaattgccctcccggatttctactttgaactagtcctgagagagttactatagctccatcaagccctgttacaatgtataagaagatctcagggaatctacagggaaggagattttctttctctaaccccagcatttttttgtaccaagaaaaataaacatgaaagaggaatagacccaactaagagaaggcaaatgagaggtggattttaccgatgctttcagcaggaggaaatgaacctgtaataacccctatgctcagggacaatacatttaagagagctgggcacaaatccccaaggcaaatcaagtttccatttcaggactccagcccaatacatttttgttttctattcccccaaagtatctgtcaaaactaatgtaggattcagcagtaaattccttatctagcatgcatgaggccctgggtttaaccctcaacacacacacacacacacacacacacacacacacacacacacacactatttacaatagacaggttgcaatttccccagccatcctcagatctttttttttttttaagattttatttatttattatgtatacaacattctgcttccatgtatatctgcacaccagaagagggcaccagatctcatcatgaatggttgtgagccaccatgtggttgctgggaattgaactcaggacctctggaagagcagtcagtgctcttaaccattgagccatctctccagccccatcctcagatcttaattcaacttccactttagcatctataattacttcagcaaatgaatccttctctaggaaacaggaagacacacctcaaacaaaatttcctgagcagcaactaagagttctgcactttgttagggtggtaaagaatgtagtgactcacatataaaattattttaaaaacacataaaataacaatccaaaagataaccaaaggcaggaatagtgtctgctacatcaaacagtgcccttgaccaagttttgcaaacacctgactaaaattacaaactgtcccatgccttcgtgactaggaactccgctgtcattttcttaacccttcccagaggtcaggagtgactctcaagatgatttaaggccaaatctcgggagggagggacgtggacagacctccctccccatacggattagaaagagtctacaagtcttccttttccttcattcattcaacaagtgttaggttgtcccaaatactagggtgggcagtgaaagccacagggccgtttctcaagttttgctctgataacctatgcattcccctgaactacacaagtaagaattcacttaagtctctaaaacaaactaaaagaacctcagaatccaaagggactgcaaggagacgtgtgtcctcatttttcacacggacctggaacctccagttatcttactcaaggtcacactgtgacgggcgtggactagacaccccctcccacgttcccccgattacggtcagtgtcccccccacccccttctcccagacagcgatgctcatcccataaaggtccgaggtcactgccttctaaaacggcggagaagccaaggccaaatggggggtaaggagaggtgggaagctgccccagttgacccgtggaaaggcggcaggcaaccgagcaacggcacgggctcccccacttctcccctgctctcccgccccgccctctccaaccccgagctggagacgcgcgtgcgtctgtagaaaagtatccctgcactcacaaggactcgcaccagcaacgccatgttcctccacgatcatttccgggtgaagggtgggcttccggaatcccggttgtcaccacccactcaggacgctgccctctggctaacgggactcaggctccggcaggcagcgcaggcgtagttgtcgcactgcgcacccgcgggttgcccaccgtggatctgaaggaggctccggggcgcgcgacccctcgcgggtcttctgtccccgctgtgcgtcacaagggctcgcgttcttcccccacaccacctcccgggcccccggcctgtgacaccccgctcacccttggggaaccccttgaccgccattcctttcctgactccacccccaggagacgacccggctgcagggagcaggacttcggtgtcccagtggcttagaggagctcggggagcctgagaacctaagagcacagtcctggaaagcagacccgacgcctggcagactcaggaacgtggggcttgtggttggctggttaacgggagcatctttgagtattgacaggaaagagtaaatggggagaaaggagcgtggaaagcgttgcctgtgggaatgagaggatggtcttgactgaagaactcttgtatgccaagagaagtagaaaagagaagatactgctgctttggggactgaggggaagccgaagacctagccgttgaagcgcttcctctccacccagtcaatacagacccactgggtattccgtatggactggacacccgtccaatgtctggtaaccctgtggagcttgtgagctcgttgaggaaagtacgggtagatttgtctagacaactcgtgagaaaaataaaaactggtatgaaggaaccataaatacctaataaagataatgatatgggcaactacctggccagcttagccagataaaagcccatctgaggaagtgacgtgtaaggtgggatgcagggtatactttattttttatcttttcaacaaaatttcttgtagcccaggctgacctcagactcttaagtatatgaggctggcctcccctgcctcaagctcccatgtgtgtgtggggggggggggtttacaggttgtgacactaggcccagcctcacaattttgttttggtgttttgagcagatctcactatgtagctgtgtcaggcctggaactgagaaccaactgcctctgccccccgactagcagccaccacatcgggcaaaattctgtatgtttatcaagtttgtggtttttaaatatttacatctagaatggctaaattaagcttatgaccggacaagacagtgcagaggttcctccatcttgttttgtttttgttttgaggctgtataatagccctgtaagaccaaactggccttgaacatacagagatctgcctacctctacctctacctcccaagtgttgggaggtggcatgcaccaccactcccggcattccatcttgtattcttgctgagaccatttcaggtttaatttgatcttcatggacaatcccgaggaaaattacccaactctattcaaggaaccccaggtcaagatgccctatttaacctattttagcttctgttgaactgcctgcttgtgcaaacttccccctctggctagctacttaccttagcttctgataaattgcttgcttacatgaagcaccctgcaacttccgaaggagatgccaggtcatggtttctgccttcaaaaaccccatgctcggaacactcggcactaacttagtatctggatacttgagtatagtccagactagctggaataaagacttaaaattgcctataaactgtgtctgagtgttcgtctctggtgggctccctgtacaagttaatttgagccaggagtgatgacgcacacctttaggcagaggcaggcagatctctgtgacttagaggccaacctggtctacagagtaagctccaggacaaccaaggctacacagagaaattctgtttcaaaaaacttgaaaaaaaaaaagtttttgtaggggtcttccatttggtctcctcggtggctattctaatttatattcccacttacagtattgccagtgttcccttttctccacttctcatcaacacggttataatagctagcctcaaagatgtgatatcctattgtggtttcaatttgcacttccctgatgattaataatgaaatagtttccccgtgtgcctatggccaattacatatattctggggagaaatgactattctcaaaaatcctttgttcattgttggggactgatgttgtcttttggttggctagttggttgggtagttggatgggtagcttaagacagagtctcactaagtagccttggctggcctggaattttctatgtaaatcagactggctttgatttcaaaaagatctccactctgacggctgtgttctggactcaaaggcatgtaccaccacacttaataccactgtcttgtggtattagggatcaaacccagaacatgatacatagcagggagggggcaaaaaccctaccaataagctaccctttgcctagtctttaatcagataattttgttgccattgcactgagtgaagtctttatatattttggatattaacatcatgccagatatatgattaacaaatactttttccactccataggtgtctcttcactctgataattgtttccttttctagtttgaagtagttacaactgtctttgttttggttgtgttgtttctatactttggagatcattaaactaacaaacgaaaaactactgggggttggccatgatggtgcatgcctttaatctcagcacttgacaggcatatctctgttagaggccagcctagtctacatagagagttccagaatagccatgactatatagagattctctctaaaaaaaattaagactagtaataataaactgttgttggagctggagagatggcccagtgcttaagagtaaatactgcttttctggatcaccaagttctattcctgacaccaacataggtggctcgaagtcacttgcaactccagaagatccaaggggatttgatgcttctggcttccatgggcacctacatgcgcacagcatgcacacacacacacacacacacacacacacacacacacacacacacacacacacacacaaatattggagccatgtaatcccagaactcagaaggcagaggttggtggatgatctctgtgagtttgaggtcagcctggtctacagagccaaatcctgtctcaaaaccacaaaagaatatttggtcagggtgaaggctcagtgggtaacatgttcgctgcacaggcctactgacctgagtttaatgatccctggaatccacataaaaagctgatgggtggcacacatctgtaatcccaacacttctactatgagataggaggcggagacagaagaatcagggagaagctcctgtagcatcatgggttttattcttctgaactctgggagtgcaccatggcacatgcttatccacactcacacacacttgtttaagaaaatgttgcccagaccaatgtcacggagcttttcacctactttttatgcagtggttttaagtttcaggtctaatgtctaagtcctcaatgaacttttgttttgaaacaatcttatactgtgtggttaaggctgctttcaaactcatagatccacctgcctctgcctcctgaatgctgaggtcttcagtaaattttgagttgatttttgtgtgtggtagaagtaagaatctaggacctagagacctgacttagaggttaagagcactggctgctcttccagaggtcctgagttcaattcccagcacccacattcagctcacaattgtctataactccattctaggggatctggcccccttacttgggcatacctgtgcatacctgcaggcaaaacaccaatgaacagaaaatgataataaataactattttttaaaaagaaagtaaggatctaatctcattcttttgtatattggtatataatcatcctaacatgctcattttgtggggagagagagaaagagagagagagaggagagagagtgtgtgtaatgtttatcagattaaaaaaatattgattcctttttatctgtgtagtactgggtgtcctggaactcacactgtagaccaggctgagctcggaccacagagattctcctgcctctgcctcctgagtgctgggattaaaggagtgcaccactatgcccagctaagaaatattcttttttttcttgtttttattgagctatttcttccccatttcccttccctcctcctctctccccctgaccctcacctcatccccccacactcccaatttactcaggagttcttgtctttttcctcttcctaggtgggaaatattaattcttggtttgctgagtttgtagatgtgtgcctgtgtatgagtgtgcacgtgcacgcccatggaagccataggtggaaatcaaatgttttcctcaatccctctccaccttattttgcaattttattatttattattaccatgtgtgtacctgtgtatgtaggcgtgtgccacagcatatgtgtggaaggcagaggacactgcccagcctcaccctccttctttatgtgggtttcaaggacagaattcaggttgctaggtctgacagtaagtgctttgtatgcactaaactgtcttactagcatcactgtatctgtctgttagttttttgagacagggtctctctgtgtagccctggctgttctaggattgtctatatggacagagatcctcctgcctgtgcctccctggtcctgggattaaaggtgtgagccatcactgccctgctctcaccgagttgtttggttttgggttcttgtttttagacagttctctaactgaatctgaagatggctaatttggctagacaggctggctaaaatgctccagtggagaaaaagaggtactctgagtgtgccgaaggttgatgacatggatggaggctgaaggaagtcaccagccaaggggccacgtaaacaaatgaacaatgacttacaaagtggtcatttctttcttgggtttcacattgatgctgagtccaaactcaggtctgtgctatctccccagcctcctccccaggcctttctcccaggtcttttgtatatagtttcccccccttagaaaatgtatcagtttagtggatgtggtttggtttggtttttgcaggtttttcagagtttggcaaatgctaagcaagcactataccagggatacaccccatctcttccatagttctttttttttttctgagatagggttgctatgctggtctcctggactcaagtgagcctggtacctctgcctccagagttgctgggctacaaatattcaaccaagcccagctttaagttgaaaagtttaggcatgaagaatttgccttcaccactttgtaagtcatcattcacttgttcatgtggcaccttggctggagtcttccgtcagcctccatccatgtcatcaaccttcggcatgcccagcctacttcctttttttatactgtcagtgtcttccccaaaagttgctctaactccagttccagattcccaagtagtatataagctcttcacaatcgcagagaattggtacttttttgtttgtttgttttggcttttcaagacagagtctctctgtgtagctctggctgtcctggaactcactcttgtagaccaggctggccttgaactcacagagattcacctacctttgcttcccaagtgctgggattaaaagcatgtgccaccaccacccgtcgaggattggtactttacctcatctttagacttcaaaatgctttaaaccaagagtaatgactcatgcttataatcccagccccaagaatgctgatgtaggatgcttgctgagatcaaagccagtctgaactaccacagtgtgaaatcttgtctcaaaaacaaataccaggggaaagactaatatgtcgaaagtatattatatacttgtattaaaatgtctgtataagcccagtagtggtggtgcacgcctttaattccagcacttgggaggcagaggcaggcagatctctgtgagttcgagaccagcctggtctataagagctagttccaggacagcctccaaagccacagagaaacaatgtctcgggggaaaaaaaaatgattgtataacacacagtatcatgtataatgaacatacaccaacaaaaatttttcagaaataattcataagctttaaaaaagaaaagcattccaagatctgcctagggagcgagctatacagtacagtaactcacctataggatgaaggttatagcagctatgtcatagggtagttgtgataattaaggatgtagggatttagcaccatacttggtcccatccaaaggcgatgtctatgcatctcttagtacattgctctagcctctcgaactacatgttctgatggcatctcttctacctacagaaacccttcagctgggatgatgtttccttacacggctgctcttctcctcctccctcatccttgtagctctagtttcttcagctaaatctcttaagactttatttctagacctctcactatcacaacctcctttgttcatcctgtaatggcttagatcaagaagtcagaaaacagctgggcatagtgctgcatagctttaatctcagcactcaggaggcagaagtgtagacagaatattctgtcttctgccagttaactctgtccatccagccagctcccaaataaccacttggagatttcttattaattataaatgcttggctgatagcttaggcttgttactaactagcttttacatcttaagttaacccatatttctaatctacactctactatgtggagatatttttttcagcagggcatgttcatcttcttctccatgcatctcctgggtagtccacccttcttctttctagcattctcttagcctggctcttctgcctaacctcttcctgcctagctattgaccagttcaccctttattagaatcaattagagcagcacacattcacagtgtacaagagaattattccatagcatttccccctttttgtctaattaaataggaaggttgactcactcactcagtagagcatgagactttttttttttttttttttttttttttggttttttgagacagggtttctctgtaggtttggaagctgtcctggaactctctttgaagaccaggctggccttgaactcacagagatccgcctgcctctgcctctcaagtgctgggattaaaggcatgtgccatcaacgcccagtgagcatgagactcttaatcccaggatcctgggtttgagccccatgttaggcaccagatgttgcatttatctaataattctctatcaataaaaaacaggagtcagatatcgaggtaagaacctgaatgatcagagcagcatcggtgaagtgaccaatgacttcctgtctcttccattcctccattcaaaaagactgagatcctctctatgccccgccctactacttcctgtctctctatctgtcctcagtcctctaaaacctctatgattaattttggtccgctagtagctagcaaccccctttgattcaaagcaaactttattgtcagaatgtgatcaaaatatcacacaacatataagcaagcagatatctgtgagtttgagaccatcctgatcttcatagtgagctccaggtcacctggagatacacagtgagaccctgtcttaaaaaataaatttcagaaaagtctctaaaactaaaccaggtgtggtgacatacttgaataatgagcacttttatgttttctttgcttctcatctcacagggttagggttcagtcccagagtctaggcaagccagtatacctctgaacaggactgattgtctcagtcctgaaactcttgtactacacttgttataattatattcaggcagccatattgcattccattaacttcatgggcttcacagccacctaccacatcatagtcttccaatctgaagtttcacgttttttcatacccatacttacttatggagttggtttcatagatttaaatggataggtttttttttctcctattctagttcatctactctcatccagccttccgtatcccaacatgctttaagttctttgtgttcttttccatttgttcatgaaccttaagaatattgtaaatatgaaaattcccataaagttcaaagtacaagaacctgacacatggtaagcctttagtaaacatgtgcaatacttctatcatcatcctaacaccaggtacagtgtctgtgcctgactagaccttcagtaactattcattaatcaatcaataaatgactagataaaggttcattcattggtgaaatgaatgaataccatcatataatgaatctgaagattcatagtttttcaagagtgtgtgtgtgtgtgtgtgtgtgtgtgtgtgtgtgtgtgtgtgtgtgcgcgcgcatgcgcgcgcgcgcgcgtgtgtgtttcaagataggatttctccgtgcaacagaattctagctgttctggaactcactttgtagaccaggacagccttgaactttcagagatctgccttcatcttcctcctgagtgctgggattaaaggcatgcactaatcgctgcctgacaatttatatatttttatttcatgtgtatgagtggttccctgcatgtaagtatgcgcagcatatgtatgaatggtgtccacagaaaccagaaaaggatactggctcctttagactggagttacagatggttgtgagctgctaggtaggtactaggatccaaacataggacttctgcaagagcagcagtgtttttaacagctgagctatctctcaggtcccagaattataacttttatattgtccatttttacagacaaggaaactgagacttggagaggttaactgacttagcctgggccacttacctggaaaatgatagaaccagggctggaactctccgatccccatcatgtgactagcctcgccctactctgcttcctcaaatgtatgttcaaatcaagagatcccataaggcttcccgagatgtggtttctcctgttgtgaccctgggacacaggatgtggaaagggcccagcgatggggagtggagtgctggaagcctccttctttcctcccctctgggcctctcatgtttcctgtcctaaactctgctctgatatttttcccaaggaactaacagcatggtgtgtccctaaggagagagttttggggccagagagccaagccagggaggtgactccattgctagccaagacaggggtcaacagactcaggggcccagaagagtgggtgtaagaatgaggagatctgcaggagacatgtggttgccactctgcagtcctctaagtaaaaaacaacagaagtcagtggtcctcttaggagctggacatggttgtgctcacttttaatcccagaactagggaggcagaggcaggtgaatctctgtgagatcaaggtcagcctggttaacattgagagttccaggacagccagagctacactttgaggaacacacacacacacacacacacacacacacacacacacacacacacacacactcctcatattgcctattcttaggacaatttgaggcacaatagtgacaataatgtttactgagtgtcatctttgtgccacttactctattaggttgagtgtctttcaaaatctcacagctagttttatgaaatagataataaatatgatgactacccccttttctttcttatttccctctttccttcatttacttcccttctttctcaaataaggaaccaagcccaaccaaatggtacatacctacagtcccaaaagacagaggaccagcctcggatacacagtgaatcataaggcagcctggccacatggcagcacctacttcttgttcaaagctgtaactttttcttaagatttattttattaccaggcaatggtggcacacaccttcaataccagcactcgggaggcagaagcaggcagatctctgtgagttcgagaccagcctggtctacaagagctagttccaggacagcctccaaaggcacagagaaaccctgtcttgaaacccctcccccaaaaagatttatttatttattcattcatttatttatttggattttttgagacagggtttctctgtagctttggagcctgtcctggaactcactctgtagaccagactggtctcgaactcacggagatctgtctgcctctgcctctgcagtgctgggattaaaggcgtgcaccaccaacaaccggtttaacattatttttgtttatgaatatgtgtgtgcatgcacactcatgtatatgtattcacacatgtgtgcaggtacccacagaggccataagagggcttcagatcccctggagctggaatcataggtgcttgttaccacctgatttaggtactgggaactgaactcgggtcctcagcaagggcaacaagcactctaaactgctgagccatttctgcagcccttaaggcctataactgacagaagacaaaactgaagtttgaaactacacaagcttttgaacccttcagagctgaatgactatggagagtgtgaactatggtgcagaataaaaaccctgtgttgtttgtgtgtgtgtgtggggggggtacgtttgtgtgcacatgagcatccaaatgtgtgtgtgtgtgtgtgtgtgtgtgtacatgtgtgttatgtgtatttatgtagaggccacaggttgatgtctggtgtcttccttggtcactctccaccttatgttttgagacagagtctctcttattgaacctggatctcaaagattcagctaggctggctggccagcaagccctaaggagctgctgctatccttacctcccctgcacagggcttacagacaggtaccactctactctgattttcatgtgggtgctggggaccaaaactcaggtcctcagggctggaggagagatggctcagtagttaagagcactgtttgttcttccaaaggtcctgagtttaattcccagcaaccgcatggtggctcacaaccatctgtaatgagatctggtgccctcctctggcctgcaagcagcatgcaagcagaacactgtacacataataaataaataaatcttaaaaaaataaaaactcaggtactcacacttatgtggtaagtacttcaccaatgaaccatctccattgcctcagaaagttctctattctttaagcaagaattcagtacatcagtatacagcttcctgtgattgtggtcagatgtggtgctggggaggagagttctccaaagaggctgttgccctgacctgatctgaaggctggaatgaaaggactcttgccattcctggtggtcagattggatccccagatttgtttttttgtttttgtttttgtttgtttgtttgtttagttttgttcagggtttctctgtgtagctttggaacctatcctagcactcactctgtagaccaggctggcctcgaaatcatagagatctgcctgcctctgcctcccaagtgctgggattaaaggcatgcgccaccaacactggctggatccctagatttgtatgaagcggctgtaaagtgtgggttgttcccttgagaaaaagagctccagggctggctggggtgggaaaggaagcttcaggggtatccagccagagttaagactattcactcagtgcctagcccttcaacaggaagagctctgtgactcaggtgatcctctgttggggctaaggcaagaactttccaagaaacaagagataaacaacctaggaaataagtacttggggcagccagtgccacctgtgaccccttcccgctgtctctctgcctgtgggtttctagccacctcgcgcctacactgctctttctgtatccatagctgtctccttggccttgccagaaccttcctctgggctcattctcctctcacacaccaggcctctgtctgctgtggcagctcttttgtttacttccagagctcccaggcacactactagccaaacacaacgaagccaagccagagagaactctgttccagactcagtcttgcccctctgggacaggtaatggcctccaaaccaaggaggcagctcaaaagagggctgccccctacactgggctcttgcttcaggtcctgacaacccaaagggaaaggacacaagacctgcccattgttgggcagggatccctactcttgagacagctttggctggcagccctgggaatcaaagacccagctggagagaggtggggaaaattttgaggccctctgggtgggaaccagagacttggacttttggtcttgtgtgtctctttagccaggtagattctgaccttgagccctcctctctgggatccaggtgcctaaatttccccaccagaggactgtcctctccaaaagttcatgtcccatacctcttcaaagattctagtgaagaaagggaaatgagcatttactgtgggccaagttccaagcaggaagcactgtgaggatatgcctggcattttctgtccgtctgaggtcaacagggagatgggtgattggtatgtaattatgtacttgtataatgtaagatgtaaagggaggactcaacttctgactctgaacagtcaagtgcttcgatcacacagagccagagtgcagcagaggggtcccaggtcagatcatgctggtcatgccagaacagtggccaatggtagaaatgaggtaacaccatagggaggaggagacccatggcagcccagattcttcagaggaaaaaagcagaggaccccttcagtgagacccagtcaagtctgtgattagggacactgggggacccaggattgggcaaatgctggttaacgaagtggagataatttgaaaggaaaccagggccccctccccactcttaaggcttcattttggagaccgtgaagttgattaaggaatgtaaaactctaactctttgctaggccccaatggagcagaaggagctggggaccaatgggcctttggaaggatcaggaatggggttagaggtgagcactggccatgaccagctgtactctgggcctcattctgcttcagttcccaggagtgggggtggggtccaagcctgggaaacagttcatacctgaggcaacctaccttcactcatagggttagcaattctgtaaggggtctggggcccctggagtaaacaagaaatccgctacaactttaggcatgaagattcagctttttatctcatcaacgtacattttagtctaacagtctaataggctcatactctacccaagtcctttacccttctccaccagcccaggcaaagagcatctaatctgccctacgggtggaaagtcaccaggcacaaaggtaattcaaggagggggtggcactgcggctgtcccatgaagcgcttaggatatcaccagctcctctggagaccgaggaggccggagcaggagggatgatggcccgagtctcctctcctgggtcccagtcccactcagagtctgttctctgggcctgtcactgcctgtcagaggagcagaagggcaggaatctccagatggggcacggttagcccagatcacacccagagagtacatccattgaaatcccctttcctgcaggctgtcgggatacttcacaacccctctgtgattccaggagcatgtggaggggttctctctggatgtgccaccctggaagacagagggccggtgctgctacctgcagccacaagattccacgaccatgtcctcgtactgtttatacaccacgttgttggcagagtcaatgaagaggatgctaatgggactcagccgtgtgggcacacagcaggtgggtggtgtggattcagggtccatagaattcatcagggtctggatgactgcatggtttgtgggctccaagtgggagcgcaaggggaactcgcatagtccttcgcaatggaaggcttcgtactcaaggggtgcaatgatccagtcgtcccagcccatgtccttgaagttgacatgcaaagctttgcgactgcagcgagccttgaggttcttgctcggtcgcttgccctggcgattggccagtggggcccgccgtttccgccgctggctgaacaggtattcatacacagtcttgtcatcctggccagagcgggccttaatctcattaaagaacaggtcccgtttcttagtacgaccaaacaccaggaacagggccttctcgtggacttgtcgggcagcgcgttcaaagcccaggccgcggaggtccacagcccggccccgttcccaggcctccagctccaggcacagctgtgctgagttcttaaaatttcggaagagtttccagatgtcgaacacctcccagccagatccatccaggcctggcacggagcgcacatccagcaaggctgccggctgccggccgctggggcagctggacagcttcagctgggcaacccgcccgctactggggaccgctggcttggccatgtccaagggcttcttccgtaggatccgcagttcagcccccaacagcccatccttctccagagcactgatgtcaaacacgtacctctgcttcctgaccacagggcctcggtcatctggagaaaacagccggaagtcaattcttgtcacttcaccaagatagtctagcctgccacctcggagcctccagggaggacctaactctctcccactcaaaagacattcctttaacctcttccccactatggccaaagccaacacccaaaccaccaagagcccttttccaaatgaaggtaggtgtgccactttgcacgatctcagtgccctcgccattcgtgatctgtatgagagccatcaaacagtataccggtgtccgccccacccatgagcacattattatctcccatacgtaagacaggtgatatgtgcatttaaactacccactcttccagaggaggaacctgccgctcagagtaagttaggggactcattcaatgtcctctacctgggggaaagtagaaatagaactgtagcctagaacttcaatactcctttcgagcttcctccacctgaaggaccttagcgtttttgttctgggcaaggcacagagttggggagtaaattgatgtaggtaacacagcagattaataacaaagcccatctgcaactcaacttccctagtttccagtctgacaattttgtgtccatgagtgtggttcgtgtgtgtgtgtgtgtgtgtgtgtgtgtgtgcgcgcgcgcgcgcgcgcgcattcgcgtgtgcaattgggttcccgagtgagtataaagtaatatatatgctattggcacatgcaagtacagttgggcttcaatgagtacttgaaaaatgatgatatatgtatgtatgcatgtttgtgattcgtttaccatgtgtataaaatacaaggctctgtgtgtgtgtgtgtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaggtgaaaataattacccacacacacacacacacacacacacacacacacacacacacacacacaaacctgcaggtgctcagaaaaatcttttacaaacctgaactcaggaattggaaacggaattccaacccaaaccaatttaattactctctgatgtcatgctgtctaaattcatttaagtgcgatatatttatgtgaaaaaaatcaccactgccctttagaggccacgactcacgggggctcttggctcagagccccacagcgggactcaggcttagggggcctcccaaccccagaacagacttaggggtcttcacctccacccgctggagcagcccaccccaccatcctgagcagagatgctgaggaatgagttgcaaagacctgcaggcactaggtatgcgagttaggtttttcagtgaagtccgaggagtgtctataaaacagtttcaatccctctgtctagtctgggacctggtgtgtgcgtgcgtgtgtgtgtgtgtgtgtgtgtgtgtgtgtgtgtgtgtgtgtgtgtgtgtgtgtgtgggtgtgtggggggggccgcggaggcggnnnnnnnnnnnnnnnnnnnnnnnnnnnnnnnnnnnnnnnntgttgtgtgtgtgtgtgtgtgtgtgtgtgtgtgtgtgtgtgtgtgtgtgtgtgtgtgtgtgtgtgtgtgttgggggggcagcacagatggcagcatttacccacagtttcttttattttaataaacttgtgacccagaaacagaaaaaaaaaaatagtgcccattataccacccccaccaaatgccattcgctaagcactgccatcctgtagcccccttggttgaaaacaggtccagagtgagtgtacacaggcaaagaccgccagttttcttagaagaaattggctggggccagaggtagcagcccctgcctaaggcagcagcgacccctgcaggaagttggaagagaaagttctcatggactacttgtgtaatagctggtggagaaagctgaattcctgctcaactcaagagtgcccctcgccttccttttcttcttcttctttagacaaggtctcatgtagcccaacctggcctcaagttcactatgtacccaaggctagccttgagctcctgatcctacacctaccagagcctgagatgacagatatgtggcaccacctagctacaagggtttcctaaaatgccttgctaaagtatttaaacaccctttctttggagattccgtgttatagagccctgggaaacttactcagggtcaaggagaagggggagtgaaaccccaggcctccctcaagtgtgataggcaaacactaccgcagagctccacccctagtccagagtctcttcccttttcttgagacagtctcctgtggcgaaagctggccttggacttgcaatattagctgaggctgccctggaagtcctgatcctcctacacccacctccttggttacagcgtgggattatggaactgtaccacctgccctagccttcctttattaatcctcaaatcttgcagctgacctaacagatccattcacacgctaaagttggtttctagagactctctgctggagtctaggcatgtaactcagtagtctcgtgcatggttagcatgcacagagccctcaccaagacaaccccaaacaaagtcctcactccggatagctaagtggctgcaagtctattttcttttttaaatattttactttgtttatgtgtatgtgtgggaagagggtgccacaggagaccagaaaagggtattaagtcccttgaagctggagtggcaggcagctgtgtgccaccctgacatgggtgccgggagcagaattctgtccttccccaagcagaaagtactctttttcataatgttgttcctggttcacttactcagccactccaagtttcattgatagctccaggtctgaagcctggacttccaaggaccaaggcaccacctgctttcttcagcgagcttggaggatggcttgaactcattacagtccctcaagtcatccaggcccagcactcttgtctttgcttctgacttctcttcttactgtcctctctggcatcttcctcctacagtctctgtcactatcctgacccttctcacgcttttacctgccacatttcccttagaactgacttcttggtctccaggacctcttcgtccctaaccccccccacccacaccacacacacacctaaagcctacccactgagcaagagctgacccagctgctacttgacacaaagtcaacgcttactccccaggaaaggcatgaagcttccaaacaacaccacatacctgctaggtttctttctgctcttagagttcaaatccacccagccacagcccttgctccatctgcaaggtagttcagtttttcacagtctgtttgtttttttcatagttttattttaactgaattccttatgcctatcataatttatgaacatatctgtctatcccattagattataactacactgtaccatatttgtctttcaattattcccaggccttggcacagagcccagcacagagcagattctcagtgtgtgttgtatgaatgactctcagactggcccttttaaagaaacactgtcattttcttttttatcatttctttttaaaaattagaataaataatgggtttcattgcgatattttcatacttcatattattacactttggtcatattctctcccctatcttctcccacaactcagactccttcttcgacaaaagtaccctttctactttcctgttctatctccatatatttaaatatataacttctgcataagaaaggaaataattggatgttcgtgtcccttcccccacctccattagtttactgttcccacatcttccagtagccactggtccttcttctgctttcaagtcatatatataaatctagatgctaatataagagaaggcatgtgttatttatctgcaaagccatcattttaaacattccccgccttttctactgtacttgagtccctaaaagggagagacgctattttgctaccaagaattttctaagctctatcctctggataaacaaagctatgaaccagtccacgtagacatccaatgagtggttgataaagatggaggttctgcaggcaggtctgggtttgattcttggtggttctgctatttatacactgtgtgatgccggagagccttccaaccactctgcagctctgagcaggggtaatgacagtactgtcatacaaagagctcctgtgggtatttggtggagtgaattattaaaaacctgagaagatagctggagacatggctcagtgggttaaaggtgcctgccaccaagcccgacaacctgagcttgatcctcaggtcctacaaagtagaggagcaaacagaaccaactttcacaagctgccccagtccccacctctctgaacacatgcacacatacacacaaaataaatactgtgtaatgttttaaaaactctgataaatgttagtaacagctacaccttgaggacatattctccatcagatactggcttgtgttctattacttttaaaaccttacttcacaaccacaccccactctgaacaacttttgctgacgatccttttagcctccttcgttttacagacaaataaattaaaagtttaaattacttttaaaaattatttctttgtgtgtgtgtggtgtgtggtgtgtgtgtgtgtgtgtgtgtgtgtgtgtgtgtgtgtatgtgtgtgtgtgtgtgtgtgtgaacatgtgtgtttggtacccttataggccagaagaaggcactgaatcctctggagttcaatttgtaggcagttggtgcaggttctgagaactgagttcaggtcctctccaaaagcagtcagtgctcttaactactgagacatctgtccagcccagctcacaaacttatttatcgttactatgaatgtgcatgcatgggtgcatgtgtcccaccacacacacctggaggtcagagagcacctttgcaaagtctgttttctccttctgcctttacttgggtcccagattgaatttaggccaagcttttgtgacaagcaccttcacccgaaagctgtctcactaccccaagttacttttgaagctcactttctgcttttccaagttttgttttgtttttgttttacaagacagggtctctctgtgtagccctggctgtcctggaactcactttgtagaccagctgcccttgaactcagagatctacctgcctctacctccagagtgctgagatcaaagaagtgcgccaccaccacctggcaaacttgaactcgtgaatctccttcctctactctgtctagtaggattgcaggtgtgtattactacacccatccctttccccatatttttaaaaatgacattaaaattttttatttctctttctttctttctttctttctttctttctttctttctttcttcctttctttcttgtttttgagatcaggtctcactatgtacctctggctgtcccggaatccactctgtagaccaggctggtctccaattcacagagatccacctgcctctgcctcccgagtgctgggggatcaagatctagcttaacattgtatttctgtttatatgtagtggcacacagaagtcagggaataacctgggggagttggttctctccttccaccacgtgggtctccaggaccaaactcgggtcatcaggttagagcgtcatctttatccactgagccgtctcaatgaccctttaaagcacattatgcaagaatctcgctctagaaagtggtcataagtgataaggtggtgtggtggggacactagggaatttaactttcagccacggactcatccagcggtctggaacttggaggacacagaggagtctcagacaggggctattgtctgaagaccaggttgggtaggagcaaggaaaaaactccaaatctggatggaaggccctctccagggaggagcccagagttcctgcctggctcttactataaaggtgactaatcactttggtcccctctggtaattgcaaccagatgctgctgctggctatgcttcagtcccgacatgtttaattactgggacacagagtctctgggtcccctgtggctccctccctcccccattcctgtcagcaatattaatgtcaaacctaaggtagaggatgggagccttgggaagccactggcatggaaataatctttacaggcccttccactatgtaaagcctttaatttctttaaatatttccccatccattatctcattggcacctcacaaaacatccttataaagccagtaagccaaagtattactagacaaacagagagtgaactgaagaataataatcccttgttttattcaaacattaggaagtttcaaaggcatttcatattccttatgttccctcaacctcccaaggtctcaagttagaccaacagggcacagtagctgagagatggactcaaggatggaatagcccagtttatgtcccagctctgccactttccagttgaccggccttgggtattcatccgtttacttaattatgagcactaactatataatagtgatcaagacatcaaagtctgtgttcaaatttcggtgaaagagacaaataaatgcacagtttgaaggaactataagtgctgtgtgggaaacaaaacagttgatatagtgtctgttctagcaaggagtgtctcaccgaagggttgtgtgttggcagagatggagacatagggaggcctcctgaggtctgcaagatgatcattccagatggagggcccagcatatgccaaggccccaagttaggaatgtgctgggtacaagtgagaaaccaaggaaagctggtgttgctaaagcagaaagagccagggggttgaatcatatgggagatcaagtcagacatgtcagaaccatatcagtgtggctttgtaagccatgaacagtgagttcagttgtatttgtagtgcactggagagtcaagcaggggattttaggcagccgagatgtcacataataactaatacaaagctaccaaccttcaaataaacccagagcctggattcacaaattatgtgatctcaattaaattttttaaaccttcataaacagatttattttattgattgatttattcattatgtatacagtgttctgcgtgcatgccagaagagggcaccagatcttattagagatggttgtgagccaccatgtggttgctgggaattgaacttaggacctctggaagagcagtcagtgcttttaaccgctgagccgtctctctagccctcagttaaattatttgatctcactgtaactcagtttagtaaactatatgacaaaagtaataataaaatcttttgggggctggagaaatggcttagaggttaagaatgagtactgcgtttccaaaggacctgagttcacttcccagcaactacatggggtggctcacaactacctgtaactccagctccagaggatctgacaccctcttctgactcctcagacacatgcatttaaacatggacacatcacatagagacacacacatatgcacataattataaataaattaagtattttgaaagatgaagtatggctgaacatgtggtgcaggcctttaatcccagcactcaggaggcagaggcaggtggatctctgtgagttcaaggcctgcttggtctacagagtgagttccaggacggccagagctgctacatagagaacccctgcctctgccactctagagcagttggttctccaaggtgcccactgcccccccacatcttcccgcctgcctgcatctggtctgtgatcaagcgttcagggtggagagacaaagagctgtatgcctctcagcaacacaagcacagaagaaatgggggggacagggtgggaaggaggggaaccttctgagaagaaaagtggctgtgggttggtgcctgtctgtgtacagggggtgattgtaggcagagctgtcatgcatggttgtacaagttttgcactaattaaggatgcccagttttagatgggtggtggtggtgcatgactttaatcccagcactcagaaggcagtgccaggtagatttctgtgacttcgaggccagcctggtctacagagcgagtaccaggacagccaggactacacagagaaaccctgtctcaaaaacaaaataaaggaaggaaggatggaaagaagtgtggtgtgtggtgtggaggtgcctgtctgcaacattagcacttatgttaccagtgggcagaatctgggtcaggcatttttagttcttgttttaggttcttgactctgtgtgtgtgtgtgtgtgtgtgtgtgtgtgtgtgtgtgtgtggttagctctggctgtcctggagttcatagagatctgcctgcctctgcctcccaagtgctgggattaaaggcatgtgccaacaccgcctggctctacagcgccatcttatggaagcattttcttgaggttcctgcctctcagaaaactttagcttgtgtcaatttgatataaaactatccagcacaatccccatcaccacataaattggtatggtggcacttgggagctggaagcaagagaatcagggtcatccttagccttggctggtctggagcttgctatgtagaccaggctggcctcaaatttctagtgatctgtctgactatgcctcctgagtgcatattaccatactcggtggttcttgacctcttatttaagggattgagataaaggctcacaccaactgcaaaagcaacaaggaaattctccaaagcagagcaatagaataggtcaatacaatgtcaacagtggtagcgggggccactgagttggttttgtgcctggtaaaagtacttgctgtgcaagcctgatgacttgagtttgatccccagaacctgcataaaggtagaaggagagaactgactccaacaaattgttacctgtcctccatatgggcagcataacactcgagcccccactattatattctatcaaatgcaaaagttattcaaagccagtgcatagtaagctatataagaccttgtatcaaaaaggaaaggaagaaaaaagaaaagggaaaaagaaagagaaagaagaggaccaagggagatgcctaggtggttaaaaacatttagtgctcttccagaggctaagaacactaactgctcttccagaggacctaagttctgttcctagcaaggatatccaggagctgtctaaactcctgttaacttcttcttgaagggatctggtgcctccttctggcttctaagggcactgcatgtaggcagtatactacacacacacacacacacacacacacacacacacacacacacacactcatcagtaagaaacaaaaaaaatcaaattatctgacatagttgtgtgaggcaagaggatccccaagctggaggtgagtctatatagttgacacaatgtttttttttttttaatctactgcccccccccacaaactcctacctcacaggtaacagttagggacctggaaaactttcttgccatttgttttgtttgaggaaggatattgtgtatcccgggtgcaaagtcccagttggtcttgaccagtttatcatgctgcccttactgctgggttgcaggtccatgctaaaatatttagcttctcgacatttggggggggggggaaggggacaacgacagggtttctctgtgtagctttggagcctgtcctggaacaggctttgtagaccaggctggccttgaactcacagagatctgcctacctgtgcctcgggaatgctgggattacaggcgtgagccaccgcactgcttactccttgccattcttgagctcagaaacctcagattcttgcttggtttcccttcctaccatcctccttccattctctccttcctccatctgacttctaaaagtcttctgctctgggatacaaggagaacactgaggcaggttgtcctttgggggtaagaaatctcatagaagagttatcagcaccatggacagatagttagcagtactgcaggggctctaaggagagctcaagcacaccctgcagagttggggggggcgtcccttctcataggcctcagaggtagggggttccttctcatgggcctcagaggaaaggaggtctcatagcaggagctgtcagctggggtgtctgattcctagatggcataggagagaagggatgtgccacattgaggagatagggaagtgaggaggacatctagttgaggtgtacccattatataggtcagggtatgtgtcaccactggtagtcctggaaacccattctgtaaacttccttggggtggtgagaatggtaccagtcagactcctggaatcacggtacctggtgaatctgtttacagactcacagacaggctctccagcagggatcacagagccaaccacaaggatggagacagcgatggctatagataggcacaactagagcactatatggtctgggattctttttttttaagattttatttatttattatgtatacaacattctgcttccgcaaatatctgcacactagaagagggcaccagatctcataacggatggctgtgagccaccatgtggttgctgggaatggaagagcagtcagtgcttttaacctctgagtcatctctccagccccatggtctgggattctaatgattcaaaaaaagaaccctagagtagtgtcaataaggtggatcacaggtaagggcacttgctaaactggacaacatgagttcaattccttgaggccacataaaaggagagaactaacaccaaataaataaataaataaatgtaaaaccaaacataaagcaaaacaaactccaaaccccaagaaccccagttgacatgtaatcgataagaagtttaagaactttattagctgggcaatggtggcatactcctttaatcccaacactggggaggcaaaggcaggtgacttcctaagagttagagcccagtcctgtctataaagtgagttccaggacagtcggggctatatagagaaatcctgtctcaaaaaaaacaaaaacaaaaacaaaacaaaactgaaagaaatagcatagcacctcatcttgaaatttcacatacgtaatttaaaaaaaaaaaaagaggaaactagaacaataagtaagtttgatacagggtcaccattggacctgcacagaaggtgatttcccagacattcaatttaggatgtaaaagatgtgcagtttgcctgaggtgactggggtccgttatcctttaactcatccatttctctctctcctctccttcctcctcccaagactttttaattttctccttataggcctttgtccttccaaactatgaacacccatttgttgtcccaaatgtcccttgcactgtgcaggaagcccaaaggctcatgtatccactatgtgcccagactatctctaggggacagtgtcacccacttttccacatcaggaaccccactttctgctttggcccaggtagttcccagtggtaccacttaatatttttatagaattttcaacaggttgttaacacattgtgttattatctgataatagaacataactgctcaataaatgcttgctgggtaaatggataaattaataaggacaggaaagactccccatttacaaagctcaatgattactgtttgatattgatttcctactttattgacccccttttattggtatattttggtaatctgaaacctatatccactccctaaagtatgctggcagtttgctgatggattttctgttttaatttttggttttcgagtcagggtctcatgtagtacaggttggctgtgaaactctttttgtagttgagaatgactttgaactgctgatagcctggcctccacctctcaaatgctggggtaacaggcctgtccactatgccaagttctatcagacccagagcttcacaaatgctaggtaaacccactaaactgagccacactcccagcccctgctgatggatttttaaaaaagagttacttattaattatgtgtatagaattctgcatctatgtatgcctacaccagaagagggcaccagatctcattctagatggctgtgagccaccatgtggttgctaggacttgaactcaggacatctggaagagcagtcaatgctcttagcctctgagccagctctccatgcccctgctgatgcgtttttatctcagtaacttttttaaacctgaggacagcttgacttatccagttcaatggatacttactaaacacgtgtcagactacatgagaaacactctcataacttcatgaagcttcaatttcataggggaaaagtatgaaaatggtaagtcagtaaataaaaagtagaatgactataaaagagacagaaaagcatgatgggaaaacatagggcaagtcttactcttcaaaaattattttattagggctggtgtgtgtgtgttcgaacacacatgcacaggtgtacatggccttggcatatatatgtacaggtcagaaggcaacttttggaagtcagttcccctcttctactataggttcctgggatctaacatgctgttcaggcttgcacttttacccatctcagccgcttgagcttcactgtagcaagcatgtgagggaaccattagagacttagacgacctagtggcccatgcctttagtcacagcactcgggaggcagaggaaggtggatctgtgtgagttcaaggccagcctggtctacagagcgagtgccaggatagccagggctacatagtaaaatcctgtttaaataaataagtaaataaacaaacaaataaataatgccagttaagccaacagctgagagtaaggtaagagagggggggtgtagtgtttatttaggtagagggtaaaatatgtaaaaaggcctagaggcagaaaagatcaggtatgtctaacattaaggttgttttttttttttccaaacacagtaacagagttttgttttgtttgttttttgtttgtttctttttttgagacaggaacatgtcctggaactcagtctgtagaccaggctggtctccaactcacaagagatccacctgcctctggctcctaagtgctgggattaaaggcaggcaacaccacctgctagcaacagagaccattcttgcacaggacttgggggttgttttcctggactgagcgctcactacagattctttgcagctctttctccagggtctggagatgtttcttcttcctgctctagatagcttgtttttcggaactacttgccttttcaatactccaccacacccctcaaagtaaccattaaagggccagcaagatagctcagcaggtaaaaggcatttgccacagagttcaatgaccccagcttgctctctggaacccacagagtgaaaggagagaaccgactcctgcaatgtcttctctgacttcacatgtgtgcattcacacatgtacacataaaaaattttaaatttaatgtaataaattagggctgagctgggcagtgtgggaacactcctttaaccccagtatttaggagacagaggcaggtggatcccagagtccgatgctagcctgcactacagggtgaattccaggatagccagggatacacagaaaaaccctgtcttgaaaaaacaaagtttcttatataaaggatataaatagagggctcaaagggtaagaatgtttgctccccaagcgtggaccttagttcagatccaatcacataaaaagctgtgaggaacttacaaagtgttcccttctcagattccctttgtgtcttaactcttctccccacccctctctcttgcttttccagacagggtttctctgtgtagtctcgctctgtagaccaggttggcttagaacacagagatcccctttcctctgcctctccagcgctgggattaagcatgtgccaatccaccacccagccaactggttctcttgtgtacacacaacttgtacaacttatacattggtttactcaacacttgctgggtatctgttttgtaccagcctcctctgtcctcaaggagctcagtcttttgtagtgcccacagggcaaaatcatgttgggtatttgcaataatgagattcctggcttcatgcttggtgtactgagtcttcagggatggactctaagtggacacttaaaagttcatttctggccaggcattggtggtgcacgcctttaatcctagcacttgggaggcagaggcaggcagatctctgtgagttcgaggccagcctggtctccagagggagtgccaggataggcttcaaagaaaccctgtctcgaaaaaccaaaaaaaaaaaaaaaaaaaaaacccctcaagaaactagaaatcaaactaccaaataatctaattaaaaagtctaattaaaaagtggggtacagatctaaacagagaattctcaacagaacaatctcaaatggcagaaagacacttaactaaatactcaacattcttagacatcagggaaatgcaaatcaaaaccactctgagattccatcttgcagcgatcagaatggctaacatcaaaaacaccaatgacagcttatgctggagaggatgtggagaaaggagaacactcctccattgctagtgggagtgccaacttgtacagccgctgtgaaaatcagtatggtgatttctcagaaaattagggatcaacctatctcaagaccctgcaaaaccactgttgggcatatacccaaaaggaggcacatccacaccacaaggacatttgttcaacatagcaacattatctgtaataaccagatcttggaaacagcctagaagcccctcaactgaagaatggataaagaaaatatggtatatttacacaatggagtgctactcagcagtaagaaacaatgacatcctaaaatccacaggcaaatggatagaactagaaaaaaacatcctaagtgaggtaacccaaaaccagaaagacaaatatagtatgtactcactcataagtggataccagacataaagcaaaagatacctattctacaatccataaccccagagacgttagaaccctcttccagaaggagatggaagcaggtgcagaaatccacaactaaccattgggctgagctcctggagtacaatcaaagtgagggaggaacgataataaaaggagtcaagaccatgatagggaaacccacagaattagctgacccaagttagtgagagatcactgacccaggtctgacaaatggggaacctgcataagaccgaaatagactctcttaatataggagacagtggtgtgactgggacaatatatgaggccactggtagtgggtccaagatctaacagtaatgtacaaactgactcagtggagcccattctatatggagagataccatgcccagcctagacacaggggtgtgggaggggagtggggggagcaggaggagaggagggagggacaactgggactggaatgtaatgtaaaaaataaattaataccccccaaaaagaaaccctgtctcaaaaaaacaaaaatccatgtctttgttgttttgttgtttgtcctgtctttactaaaactagagacaaccaggagtcaaacaaatgaaatttcaacgctaagaaattgcgttaataatgtatgtgcaatatattatgaaaataactccccttttacaatggaaagtagtcttatagaggtagtcataactggacaaactgtagccctcctggtatttaagcccttccagagaagcaatactgtgtaagggcttgcggagtactgagcagtccaaacgacactaagttgtttgcggatgttgtgttgcctgaggctgcgtggaggatccggaaacatggaaaattgagactatgaagcagtcgctcgcccagatttaatcgcaactagaccttctcggctctgttggctcaacagtgcgcaggtgcacctagcccttggttttacgcgtgcgcattatttaattgtgaagctacaggcggaagatggagagcgagtgtttcttctcccctcagaacgttcagtgctagaattcagagactgtagccgtgtctgtttttggagaacgatcgagtgtctcattataatccccctttccttttgggcctctctggggagctggctgccagtacctaatatggcgagagcccgtgcgtccccgcgctggttcccggcgctcggctccgcggggcggccccacgaaagggcgggagtttcggggggcggggcctggccgcccgtcagagcgccgcccctggcctggcctgccgggtactgggtagcttctgcggttgctgaggagcgcttcgggattcccgggaaccgaaggtggtgaggtgggtctggggcaggcgggaggtgccgagggtaacggtctgaggccagcacgggcgcccgcggggatctcgcccgggcagcggcttccctttccccggaggagccccgggcccggagaggagctgggacggtcctaggggtcccggctggcctgcctgagcctcctgctgcaccaccgcagctccggagaacttcacgccagggccaaccggctaagacgctgcgctccccgcagatctcacttcgtgctcccccgagctttgcagctccccgttaccctgcctgccgagcgctttgcacgtgatctgcccccttgaaagtcctgtcccagcccgctgctccatcctcagatttagtcaaagatcacttcttcaatatctttcctagaggcctgctccaggctcagctaatttcgattcttggtttttgcgatctttgcccaagtcagtgttcttcccctcgctcgtgttctgggcttgtttattagaagccatgtcttttttcaactgtatgtcccatgatgatagcagtaactaatgaagtttctgaatagtcgcaagatgacagctctgctaaatgcattatctgcaaaggcccctttagtccactctgcgatcgatgatgtgggttccatatgtaaacattttatacatgaagaaataagcacccataaatcaagttccacaatgagttagaatctgcctatgcatatgattgatggcttaactagattgtctttgagttgctgtttgtacattagcctgtaagatacagaggctactgttaacaattcacattttactaaaagggctttttttgaggggggcggcgggtaataggaattgaacccagagacttattcatgccagccagtgttataccactgaattaatcctgagccgtctttttgtttttaaattacatctacagtgttctgtctgcatgcatgtttacacaccagaagagggcaccagatctcattagagatgattgtgagccacgatgtggttgctgggattgaactcaggacctctggaagaacagtcagtgctcttaacctctgagccatctccccagacccctgagccctttttacttatttattttgagacaatgtctgaccaagttaccaaggctggatttgaacttggtgtcctcttgtcttggcctcacaagaagctgagatttcaggccttgtgtatccaggccaggccctagaaggtttatgaaggagaattaatgttaccaaatcgataatattcataacaaaaaaatctaggccagatccaggttgtgctcccagtacacctacaccccgtgttcttccaggacccttccaccttattttgttctttttacctagaaaacctcaggcctcagcattccccattaggaaatgctccgaggtgctgtgattttatagtttctgactttgacagctaatgcttgagcatagaatttggaatcatattagaatttggtttctactttgctgctaactagttgtgactcttaaaaaaaaataagtgcctgtggcagggcaatggtggggcacacctttaatcccaagcactcggaaggcagaggccatcagatctctgggagttcaaggccagcttggtctacaaagctacacagagaaaccctatctgaaaaaccaaaaccaaaaccaaacaaaacaaaacgggggggggggggggggggggggtgttaccatggtgtacatatggaggctagaagacaactttgtggagttggcacttgccttccgccttcatgtgggtcacactcagatcatcaggccacttctttacttgctgagccatgttcccatttcccctttcatttaaaaatttatttttaattttggggagggttgtgcatgaatgcaggtgtctgaggccttagacctggagttagaggcagtcgtcagctgcccagagtgggtgataaggactgaatttggatcctctgcaagagcaatataggctcttaaccaaagcaccacttcctcacacttagatattttgttttgtttctccatttgttttgtgttttgcccttgttgggttttgtttttgctttttgagacacagtctctttaggtagtcctggctgtcctagctgtcctagaacttacactgtagaccagactggcctcaaactcagccatccacctgcttctgcctcccaagcgttgggatttaagacataggccaggacccagctcacactaacattttttaaatattagttttccatgttcttttttttttcttctttaggattttatttgttttgattttatatgtatgagtcctttgcctacacatatatatgtgtgccatctgtgtgcctggtgccatcagaagtcagaagaggaactggagttgcagatggttgtgagtcactatgtgggtgctgagaaccgaacccagctcttctgaaagaacaagtgttcctaatcttggatccttgaatcttagttctcttgattgtaaaatgatggcactaatttttgttttgttttttgagacaaggtttctctgtgttcctggctgtcctggaactcattttgtagaccaggctggcttcagactcacagagatcctcctgcttctcctaagtgctgggattgaaggcatgagccaacactgcccaactgagacagtaatcctaataccgctaaggttttttgtgtttgtatttttttgataaggaaggttgcaactgattgttgtaagaggtccacagccacaccaccctgaatgtgcctgatctcatctggtcattgtaagattaaacactgtacacattgtgcatggtgttacttttgctttaggaatgactgtggaactctgccaatattttgtaaagctattggtgatcataagggtcatgtaaggcaggcactgaattcagatgctctcggccagcctgagctactagagcaagacaccgtctcaaacaaacaaaaccagtgcttttgtgctggtggtatttacattttggtaagttgttacacatgataattagaggcagatagacatggttagtagaaatgccagtgcatatgtctaggagtggtggtactttacatggtacaacttcccaaaaaggtgacagttgatcagaaacctggttagaacaaatcatgtggataacaaatgagaacacagctcctgccgtgttctaagcacacgtgaggatggctggccatgtggctggaggagtggcaaaggggagatgaaatagaattgattcatttggctaagatgggtcaattaggactctatgcacgattataaagatttcctttaactgtagttggctgttatctagggtgtggtggctttgtgttttgagacagggtctctatatgtatctcacgctgccctcaaacttaactgcatagtccatggaagactaacttgtagcagttcttctgcctcagtctcacaagtgtcaggattttaggcatgtcccactatgcctggctatttatggtgtgtgtgtgtgtgtgtgtgtgtgtgtgtgtgtgtgtgtgtgtgtgtgtgtgtgcctgcagttctcaggtgaaggttaaaagacaacttttatgagacagttctctcctccactctgggttctgtggactgaactcaggccgtcaggatggcagcgagtacttttactccctgagccacctcatcagccctgtttggtgttttaaaaggatcctctaactgttgtagtcagggaaaaaaacaaaacagaatttagtggtgtcaccagcacctaggaagcttgggcagtgctccagttttgttgctgtgcaaggaatcctcccagggttagtattaaacagcagttgtttgttacctcagagtcactgtgggtcagaaatttagaactgattagccgctgcttctggcttaagaggctcaggcaaggttgacagtgatctgaagagttccacaagggctgggagatctacttccatgatgcctcaatcacaaggctgttggcagaagtcccaatgctttctcctgagcctcctcactagcacttgtgtgtcctcaggacagagcaggtatttctccagagagtaagtaagcaacaagccacagcaccttctgtggccttttctcagaaggcatttctacttaaacattttcttatgatttattttattagtatagatgtgttgcctgcatgtatgtgtgtgtcattacatgtataacctcaggggtcagaaaagggtgtcagagcccctggaactgtcacagatggttgtgagccaccgtctgggggctgagaactgaatgctggtcctctaagagcatcaagtgctcttagctgcttagccaactgtctggcgttagtcacatctagtttatactacactcaaagagaggaaatttggtttcacttttttatttttagaaaggatttcatgtaaccaggctaaccttgaactcactgactttaaacactggatccttttgccttgatctttgaatgcccggactgtagatctgtgcctccaccagcaacttaggctctctttaatttttggtgggggtgtggtggtggtgatgatagtagtgtggtgggttttttttttttttctggttttatgtatatggtgtgtgtgtgcaagtgtgtatccatgtttacttgggcagggccagagattgggtgtctctcttgatatctttccacgttatatgttgagtcagggttgagcacttgaacgcagaactcaacaatttggctagtggagatagtcgtctgtgttacttaggaaatgagtgtatagagagatttaaggctgagccttgggaccctcagtcttcagatgctggagaggcagaagaccttgagtcactgccaatagcacaaattctaattgttcttagtaataaaatctcctagtcagatattggggggagaagcaaagcagcctggctctagctcttacctctgcctcagatcacatcctcagactgcttcagactgccactgcttggaatctctctcttgtctcctcctgccttatattcctctctctgcccagccatatcactcctgtctccacctccttgtggtgggattaaagacatgtgatcccagcactttgtgtgagttctgtttctcttttagaccggatcattttcatgtagcccagggtggccttgagctaacagagatctgtctgcctctgtctcccaagtgctgggattaaaagtgtgtaccaccactgcctggcctctatagcgaacgagtgtggctgatcttcagacaagctttatttgttagatcataaacaaaatatcaccacaactgccttgttggttagtaggtagcctggttattcaaaagagccagaaaggcatatttgtgtatgtattcatgaatgttggcatctgtttttgaattcttaaaatttttatggtacagtgacagacacctgtaattacaacacttgggaggtagaggcaggagactcgggaattttctttttttttcttttttttttttctgagacagggtttctctatagctttggaggctgtcctggaactcactttgtagaccaggctcgcctcgaacacacagagatccacctgcctctgcctcctgactgctgggattaaaggcatgtaccaccatcgccctgcctgagactcaggaatttttagctacgtacaagtcccaggctagcctggactgtatgaaaccttctctgaaaaacagaaagaacctatggcacacgcctttatctcagcactcaggaggcacaggcaggctgatctctgtgagttcaaggccagcctggtctacagaatgagtgccaggataggctccaaagctacacaaagaaaccctgtttcgaaaaaccaaaaaagaaagaaagagagaaaggaaggaaggaaggaaggaaggaaggaagaaaggaagtcgaacctgcaggccactaaatttataacctctggactaaggttgagatttgccaggagtaggtgtgtattgctgacaatttactaatgactaaaatgaattacacggctcttgccttgaggcacacagtggtagcaaagacagacagatgctcatggtaaaatgtaatgtggatgacagtacgatggtggtgtacctctttaatcccaacacttgggaggcagagactggtggtgaaagacccctggaggctcaggcccccaggatctctgcccaggacctcagtgaccccaatcaccaggcggagtaaaaaacttgatgcaaacagcaagaggttttattgcagttgtttaaccccattttagctcaggcctttcatccattaaccatgatggatggctaggaaagatgccgagaagccatgcagtagagatcttatagggcagcataaggggagtgtctaggggtacatacaagttcaggattggtgtgcctccaggcttgcagggcttgcccttgtgttgattggtcaactggttgttatggcccataggccctcccagggcggttgctatgctctgtgcatcattgctgtgcacttgtctataaagcacacccagagccataaagcatagcaccaccagctaacttctgattggttccttgccacaaggcaggcatctgaccaagtgaccaaggcaaggtcaggcaacctagtgctaggctgttatggctgccaaaatgggcagctggtcccttcagtgactctcaaaagttcaaggccaccctggtctacaaagtgagttccaggaaagccaagactactcagagaaaccctgtctccaaaaaaaaaaaaaaaaaaaaaaaagataatgtagacattagaatacatgttttctttaatataggtgaatgtatatgtgagcaagagactgcgagtgtgtgcatgtgcacacatatagccataaaaatttgactccaatgcttcatctgggtgggcaggataggagatagactaagccatgctatagatcgcatcttggcaaatgaaaaggatttggagttctagaaacttccacattgtatttaattgttgtgtcattgcttctgccaagatcagggcatcttccagattcattccacaggttgctgagtcacgagtcagacacaggggtgtggtggcatagcaggggttcttagtttaatgctaagtgccagacagagaggtgcaacagcatagcaagggttccagttttaatgcagagtcccaaaggcaaacctagaagcaggggtcctgtgactacgctcatcatagctccttggagaggttagagtccatcctagtcttttaaaagttctgaagagattgattggagagatggctcattggtttagagcacttgctgttcttgcaaaggatacaggcctagttcctagcacccacgtggtagctcacaactgtctataactccagttcctgggtattccatgttctttttggcctcttcaggcatcaagcactcacatgatacatatacatgcattctggcaaaacactcatatacataaatatatatatttaaaaagaaagttctagtcagtctgtggtggcgcatgcctttaatccctacactcaggagggaagcaaaggctggcggatctctgtgagttcaaggccagcctggtctacagagcgagttccaggacagcctccaaatttacacagcaaaaccctgtctcaaacaaacaaacaaaaaagttctgaggagtcctgtaataaaggaacctatttacttcattcatccagatccatttccgcttaaacatttgctgagtaaatttgaggaacctggccttctcaatcttgttatgttttggtccctagctcaagaggaggtctacgacacatagatcagtgatcagacaccctgctgcaagcagcctgtagctgcacaggaactgtggatttgttctttgatgctcccatggagacaggaagccctggattgaacatgaagcccaagtcgttacagctagtgctggaggaacaggtcctggcactgcagcaccagatggcggagaaccaggctgcctcttggcagaagctgaagaattcccaagaggcccagaagaggcaagcaacccttgtgaggaagctgcaggccaaggtgaggcaaatgcccctctgggaagggaaaaaagaacccctcacccagagttgagtgctagagtgggataaggactggatgagtgagagaccatgtaggggagtggaccaaacatcctggtgaggatggcccagatagttcaactctcaaccatagcctctcctttgatggtcacaaactgctccacaaagtatggattatgttccttccaaatatgacattcacaatagttaaattagttgtctaggtttgttctcttagtctagagtagtggttctcaaccttcctaaatcctcgaccgtttaatacagttgttcatgttgtggtgaccccaactgtaaaattattttcgatgctacttcataactataattttgctactgttatgaatcataatgtaaatatgtgtgttttctgatggtcttaggagacctctgtgaaagagttgttccactctgccaaggggtcacgacccacagaatgagaactgctggtttagaactaagcccaaacccaatacacaaagcatatattgtgtgtgtgaaagtgtgtgtgtgtgtgtgtgtgtgtgtgtgtgtgtgtgtgtgtgtgtgtgtattcaggtgcacataaactgtgagagtgcatatggaaaccagaggtcaatattgagtatcttctatcactctccatcctactttttaagtttattttgtatattgtgtgcctatgtctatgtaagtatatgttgtatgtcagtgccctgaaaggcagctggagttataggcagttatgagccgttctgggtgctgggaactgattttgggtactctgaaagaacagcaaacttttaagcaccgatctatgtcttcagcctctaccacactaattttgggacagggtctctcactgaactggaaatcatagattcagtaggctcgccagccagggagctccaggatctgctgccctgcctctgtagcactgggatggtggcttttcacactgggatctgaacttgggtcttgatgcttgcacagtaaacattttactctttttgtattttgtttgtttgtttgtttttgtttttgttttttcaagacagggtttctctgtgtagctttggaggctgtcctggaactagctcttgtagaccaggctggtctcaaactcacaaagatctgcctgcctctgcctctgctgggattaaaggcatgtgccaccaccaacaggcacattttactgaccaagccatctttaccagccccttggaaatactgataaaaaaacaaaacaaaaaccttgtgtaagtctgagagtacaagcaagcgtgcacctgacacatgttgaggtcaggggacaaccttaggtgagctagccaatgagtttagggttgctcctgtctctgcctcccgtcttgcctcaggagtgccgaactatagacacacactaccacatctggctgtacttgagctctggggatctgaactcaggtcctcatgcttgcacagcaagtgctttcctcctgagccatctccccagaaagtgtttccaaacacccggctagaaactcttaagatgctgtggccttaagaagatgactttgccatcaccacctgcttcccatgttcacagcagattcgcccaagatcccttaaagcctttggcttgtgttgtttatatgggctatagttgtgctcagggtctgctctctttgctttaggttttacagtaccggagctggtgccaagagctggagaagcggctagaagccactggagtaagtgagattgagttccggacttcctctcagcccttaaaatatactggcttggctttatatgctgccaaggaaggctggggttatacaggatgtttggtaggagttcctctgtctccagctccaaagagctaccaataaggtcttctagagacccttggcctgagagattccttcccatggtttcccatttataaatgcaggttctggggacttagcatagtggaatgggcatatggcattggagggaaaattcatttttcatccagcaggtgtcagtgtttatgcatcaggaagatgtgcaccttgcatgcctgtaagcatgcctgtaagcatgcctgcagtagaaggatgtattaattgcctgggtagggttggctgtgaaagacccttttgtcattcctcaattcctcctcattcccctaaggaaagttctcagaagaaggaaagaaccagaatgtattgagcaccttctgtgcagacccgggcacccctaagcattggtactgttatgtcagtcaagtgcaaactctgagacaaatgacaaccaccttggtttgtggtctggtgatgatgcgtgacttcctgaggtcccaaattagtgtgatagggccctagtcaaagatgcagcttgcaatcctcaggcggggtgccatttcccccaaatgccatcttttaggggaggtgattggttcacttttgaagaaaggagtgtcctgggtttgcttttatgacagtgactgagaaaagaagcaaattgctctcaagaggaagaataacagagaaagtaggctgctgttgaagaaggcgtcagggattgtcctgggtgatgtttttgtgtggtatgataaggcctgtctgtctcataagggactgatccctcagcgttgggaaggtgtagaagaaccaaacctggaacagctgctggtccgattggaggaggagcagcagaggtgatggaccccaactttcctgatctgagtgatggtgcagagggtggagaggctgagggaaaacttctgttctgcgagtgggaaagtgctgggatggtggttcatgtgggtagcataaggcaggcgggaagcaaaaaaagggggagggatcttcttggaaccttgtgtcctgagggcaaacaagattccagtcctctcattcctgatgatggaaagttccgctcactcttactcccaagaggtccaaggtgggaccagacctttatcctgcccttgttcttcctgatgcccagtgcaggtgtgagagtctagtggaggtgaacaccgagcttcgcctgcacatggagaaagctgatgtggtgaataaagcccttcgggaagatgtggaaaaattgacagtggactggagtcgggcccgggacgaattaatcaggaaggagagccagtggcggctggagcaggaggtaagaagaacaagggtggaatgtgcactctgctgctgtctgagcagtgctggacctaggtggaaactgctcagtccttgttccagcctctgattagccctgcccaagatacagctgtgccctgtttcagctttcttcctacttctgcctcgtctaggctttgctgacaggtagtgtcatgctcaactcctgcaaaagtgactatctcaggtttcaaatggatctgaaaatttactgtttgccttcttctgaaggtctgcatagctagatgctaagaaggtagctgctggattaaatagaaaacatagttataggccctgggaaatttttcagtcacaactacagacagtaaatatttcttgaacctttgctgggtgctgggtctggctgatttgcatgtattagatcacctaattctcctgtctgccgtaataactcccatttgccaggcagccactgcctgcttttctgatctagccaaatggaaggctacttttcacccagggccctttgacctcttgaacctcactgccaactttttattaagcccctcaatatgacctgagtataggcacccatccataagctatctcctcaaagaccttcttctcttcaccctcacccagtagccatgaggcatccaggactcttgtgttgctgcaaggtcccctgcccttgggtgtgacttgggtttctgaacacagttcttcaagggctatttgaaaggtgaacatgaccgtctgctcaatctgtggcgtgaggtggtgaccttccgacgtcatttcctgaaaatgaagtcagctactgacaggtcagtatggggatgagacgagaggtttgtcctgctgatctggacttaagactgcaggctctgggaagaggcactggggacagtgggcatgggctaggagggagatttactagatagagattctctcagacctgaaagcctatgcctgagctctctaccttggttccttggagtcttcaatcttccttcttgtgctcagagatctgacagagctaaaggctgagcacgccaagctttcagggtccttgctgacctgttgtctgcgcttgaccgtgagagcacagtctcgtgaatccagtggatctgggagaacagagaatgagcccgcccagctgctgctgctggtagctaagacccaggcgctggagaaggaagcccacgaaaagagccaggaattaatacagctgaagagtcaaggggatctggaaaaggctgagctgcaggaccggtgaggtgacatatggtcccaggaggactgtagtgagggaaagctgactcccctagagaattgtgggtgggcagaaaaagatgtcaggaacaccctcaccctgggaggggaaggggtccacttaggaacccagtgtgtctgttggggcctgttactgtccctctggctaccttgcaactcagtctctctcctgatagtttgtgttgctagctgttctgtcaacagcagtctcctctcagccatactctcccacacttctgtctaaatgtatgccagccatagcctggagtgcctccctccttccctctgccttgccctttaagggagagttcacatgtcacctcttctgagacttgtctcactttaatatcttgtagtcccatgagttttttgatctgcttattacagcactaatctcactgtatctctttaattactttgtttccttgtatccctcccttcttttggtggtgatggtgggggtgggttagaagtgtttttgctgtgctggggtttgaactcagggccttgcatatgctagtcaaacattctatcattgagctataccccaccttggctttcttaacttttggattataataaaatgggatttttaaaataatgagaggggaagacatgagctgagtgccactgactaccaaggcaaacttggagtctttgatctgtgtgtcatggctagggttcttccctacctgttggtagtatacataaattggggactgtttcgttttctttctgcttttagaaacattaagaacaaatcttaccttagtaggtttatatctttagtgtttcatgccttatttctcatataatagataattattgtttgttgaataatacaatatttcaataaaagacaatagtgatccccagaggtggtttctaataaaattattgaggcttaaaattttcttttagccaggtgtggtagtcatcacttttgttgttttttttgttttcaaggcagggtttctctgggtagccttggctgtcctggaactcactctgagaccaggctggccttgaactcacagatctgcctgtctttgtctcctgaattctgggattaaaggcatgtgccaccgctggctgtctggtagttgtcacttttaatcccagctctttggagttataagaaggcttgaactctatgagttcaaggtcagcctggtctatacagcaaattctaggtcagacagggctatgtagtgagagcctgcttcaaaagtaaataaataaatgagtaaatgaataaataaataaataaattattctttggtaacattgatttaagaaatacttgttggccaagtgtcatggctcatgcccatgatcctattactcaggagactgaggcaggaagatttctagttcaaggtcatcttggactacatagagaatttcaggcaagactgggctatatagtcagatgctgtcaccaaaaaaacaaaagaagaaagaaagccatgtgtgtaacactagtcacaaagccctgaggtgtgacagctgttggtgattttgcttgtcatcattagctgtattgtttcccaagtcatctgtcctttttccctatcagagtcaaaaccttgggctggagggaccttgggactgtcccctgtggtggcaattctgatgttcttattggcttcagggtgcttaacttcacaatcaagcgaggcctggaagggcctgggccagggctttccttcagctctcaggcccacagcccgcgttccagtcttgagatgtggtaaatccctgcatgtgtctgagtggcttttggctttccctaccagatcaagaatatagagtcacatgttattcagggagtgcaaaggactgggcatccccaagggattctgtgggctgcagtgggggtgtccgtgtgggggctgaggtgtgctattgtgtggcgccgtcaccatccttgggctgtccaggggacagtgatgtgctttctttcttagagtgacagagctctctgcgttgctgacccagtctcagaagcaaaatgaagattatgaaaagatggtaaaggctctaagagaaacaatggagacgctggtatgtgatcctctgtgttgcaaaggtgctcagagtgggttgacaagttccttgttctttggggacaagtagtgaatgatgctatttaaatggtccttgaggaaatccttcaaagctgaaaagtaaactttggctgaatctgaaaatttcttaactcattcatctgttcagtaaaataataactgtccactctcctgactatattcccagagaaattacaatgacatttatatatatatatatatatgtcattgtaattcatatatatatatgaaatgtgtccttgtctgagagagaagacttgtcatagtgaatttggggcctgtgtgagccacatgagacactaaggaaagctaaaggggtgggaatgagcatggtatcagagaagggttctgtggagggattaaaaaccaatttacatgggggacaactgaggagcatggcagtgtttagcctggagcagaaagaatgtgaggaagataggcttgctgcctttacatctctgacagtggagttgatggggaaagccagttgaccagtttaatgttttccagggtagagccatcaccagcagtagaagctacagataaagtagtaggttttgacttgagctagagctgtcacttgaacagtgtgtgtcttacgaaagagtgtcttatgaaagagaaagattgttctcaccatcttaaacacctgtcaggggtgtcacagaagtgattttccaagataggatgccaaaatccctggctgattccatgtttcctttcttcttaacacatttttctggtcatagacttttggcagctccagaaccctatccacatgttctcctagtctcatctgtgttggagtccactaggaagcaaacttgtttgtgcccctttaattcctttctgtcaggaatttgccaatgcagacatccacagggctcaagtaaattaaaacgagtcacattgaattgcaaagaattctggttttccagggccatcagtgttcactgctgatagaacaaagaactttaatctaggcagtcatttaggtttttaaccattttattcttagccttttattcctatattacattgttttcagactccttgggagagtatggttgacagaataaacagaatatgtctttgaatgacttggggacaagagtttggctcttaggttctattctgtccttttactaggagacaaaccatgcagagttaatggaacatgaggtgtctctcagtaggaatgctcaagaggaaatgttgtctctacagcatgtgatcaaggatatagctcaggtgctggtaagcctcttgtcctgtaactggacagtgtcccctcttcttcatatcctcttagtggccttgatttctagactgaggtttgggctaagggtcatgtaaggataagttctctcggtgaacttaaagaggtgtaggttagcattcatgtcctagcactgtgtagtggatgggtctatcctgttgcttgttatggttctcagcataggctgaattctgtctttgtcattacaaaagcattttcttccccttccccctcacttactgccccagagagaattctagccttggtgctaactattcttagatgaccaaacatgaagaattgaagggaccggtcaatttttgctcttaggtttccatccttggccctagcccagagataggacttgtaaaaggaaccttggttcctctgttctgtggtgcaagtctctccatgacactcggttgcatttcaggcctcagtggaagaagaggacactgtgacccacagctcagaccatgagagctcattacagttggactgtagtggcttctccccatttgatccccagaacccagacaaggctcttactctggtgcgttcagtgttgactcggagacagcaggctgtgcaggtgagaagccccagagctgcttagaggcggactcctgcctaccagttcccaaataaccgacttggaggcttaatattataaatgcttgggcaatacctcaggcttgttactagctaattctcacatttaaattaagccatgtttcctatctatctacgtctgccacatggcttggcaccttttctcagtagagcatgcccaccttgcttctctctgtctctgctggccactcctgactctgccctgattcccagcattctcagttttgctctcccacctaacctttcttgcccagctatgggccagtcagctcctttattaaaccaatcacaacaacatattcacacagtgtaaaggaacattccacagctgctcctcagccatagacacatatctctagtctggagtaaccctttcagctggctagtcataatgtatccagttgcacattagcttctctatttgcccagtggtgctgtggctcacaggtgtttatattctccacaccaactgcatgtatgtgcaacactaagcagagtcctgggagagtgtaaaagttccccaactccaagtgacacttactgtcccctatgccaccatgtttgaaggtgttggattccaggactccagggccacagagcccagtgatccctgattctttgacgtctccattggccacatttctgttcttgccgactgttgttacacctgtccccatccccttgccttggagtcatccctttgtttgtggctccttgttcttcatcctgttctatggatctcctcccacaggacctcaggcagcagctttcaggctgccaggaggctatgagcttcttgcagcagcagcaccgtcagtgggaggaggagggtgaagccctgagagaaaggctacacaagctcactggggagcgggatgctctggcagggcagactgtggaccttcagggagaggtggactctctcagcaagtgagtggacaggctgcttgtccctccctttcatgcttggtttttgtttttgtttctgttttaaaggaaagcaaagccttcaaaactttattttactccatgttttgttttacttaatggttttgcagctacattctcagttctccagtgtctgcttctagtcctcatttagccacttaccgtcactgtcctgtttttgattggttcttcctgttgtcactggactcatggatgcttaaggctgctttggttttctatttcctgtgggaaaaccctttggtctttaggatcaaataataaatggttttctgcttgaaaaaagttatgtatatatatttgaaaagaaacaagcttctctcatgttttgccctacaaggtctttttccactagggtcttttgtccccaggtctgtcccccagacctctgtctgtatttcagggagcgagagctgctgcagaaggccaggggagagctgcaggagcagctggaggtgctggagcaggaagcatggcgactccgaagagtgaacatggagctgcagctgcagggggactctgctcagggggagaagcaggagcagcaggaggagctgcacatggccgtccgtgagagggagcttctgtaagtgtgaccaacctctgtcaccagggtccacaccttccccaccccactcctctctcttaggaagtggagtgtgtaaaacctgcgtgtgcttcacactgcttactgcgtcttcctttgcagaaagatgagttagaaagtccatctagacattgtcgagtttctatagagatgtgggactgtgagggctacaaaaaactgatcatgatctcaaggagcttgaaacctaataagtaatgtgacaagcaaacagctgtgacgtgaagcttgaagaaatacagcctcactagagttcaagcttggtggtttggaagcgtaggagcaatagttactattcagaaccaggggcgactttatggagatggggccttgacatgtaggaaaagggaccaagggacagaatagcaaagaaaaggaattgggagtttgtggcatgttctgagttagctgtctgagaaaagacaaaaccactgggaaatgataggaaattcactggtcaggaagggaaatccagggtcagtgccctctgggaaatgataggaaattcactgatcaagaagggaaatccagggtcagtgcccccagctaatctgtgaggtccactggtaatgctacagaaaggaactgtagagcaggacgaaggtttggtgcaggtttttgctttgccaccagaatggattagtctcttggcaaaagggagatgacatttgaagagttattggcaagatgtggcagtacttcataaaatgctagcatagggctgtcaagatggtgcaatgtgagttcaatccaccaactcccatggattgtcctctgatctccatgtgagtattgtagttccctccccacatacaaataaatgtaattatttgtttgtttgtttgagacagggtctcactctgtagtcccagctcaccatgaacccacaatgccagcagagccctggtgacagctcttcacttggtatagtcccctcctctgtgccttattccttgcacctagtaaacagtagaagcttaaggaatctgccaagaggtagggccatgctgcatgtcctgcactgagggcatagcagaagatccacacagatacatatgtgtttaaaatttaatctatctgactcaacaatatagttagataagtcaaaagccaaagctgtttaaaaagataccagggtatattggctcacatctgcaatcccaatacttgggagacagaggcaagaagattgctgtgagttcaaagccagcttagactgcagagcaagaccctgtcacaataaacaacagaaaacccatctatttaaaaaggtgcacacagggaagtctccctcatcttttctcgatctgtcctattttccttccgttggtaaccatttcagttaattttgtatttatttttccagtccacttcatggaaatattctgctttctctcactttttggcatgaaaggcagtacactaacatgctgttatgctctttccttttttcacttgctctgtcttagagagctttccttactagtttttagaaatgaattccacattttttttttaaatagaaaaaaaattagattcttgtctcctgttgggatgtggtcactcccaaacacttcccttagctccccctccttcccttcttagtcaggagatgctggtgagcctggaagctaaacagtcagaatcactaagtgagctgatgactcttcgagaagccctggagtccagtcgcctggaaggggagctactgaggcaagagcaagtggaggtgacggcagcctgggccagggtatgtgggccttctcactcggaaagctgtgttcccaggaaaggggctcgatggctcactcttcacccttccgacttcaagcctttctcttcaatcactagtctgcttctgggtcctttccttcccaacatgcgctctacactgaaattcagttcactctctaaagtataaatctggctgttagtctctcaaagttgccccatagaggtggctcagcagttaagagtgtgtactgctcttgcagaggccccaggttcacttcccagcacccacatcagatggccaacaacagcctgtaactctgggagaatctgacgtcctcttctgaacttcatgggcacagcactcatatttgtacatttattcgagaaaagagacgcagacacatatatacacaggatttaaaaataaaagcctttagaagaaaattcagtggcttctcaactctggtaccatattcaacaccctttgccatctgcctcagacactctctgggctggccttcccaggcccaccacacgccaggtgtcctttgctctccccacaaaggtcagctgcgttctcaggttgtcttccttcttgactctaatacattgtatactcttttctttcaccttgactcccaagaaccatctccctctcagtattcattgttccaagcattttctcctctcccaaactaaactgatgccttctttgagttttcagttgtgtttacagtttctatactgttgtgacaattgtagtttgcacatctttctgtgtttctattctgtgagcacatttctcatgaatgaatgaacgagtgagtgagtgaatgaatgaatgaatgaatgaatgatagaaaaccttagaatggaagggaagagatggaatgatattttataaataaaagcaggttttgggagtgtttactgatccatgaaaactcaaagcaggaaacactaacttttgtttttaggcagaacagtccattgcagagttgtcagcttccgagaacagcttgaaggcagaggtagccgatcttagagctgcagctgtcaagcttggggccttaaacgaggctttggctttagataaagttgggctgaaccagcagcttctccaggtgagcaaagatttgatttccaggaggggctggaccttatctgaggattagcccttggcagacaaagctgatgccttaatggggtggggagtccttagaggattaggcaaaggcaggtgagctccagaatgtggctgaaatgagcaagagggacctctacagtgcagaggagaacaaaggattagactcaagcactatagatagccctcctctgtacctgccgctgagcctttgataggacaagggaagggtccatgtccctggaagcaagacttaagtgtttaatcctattgggtgtggcagatctgctgactagcccacgtgccctcaaaatcacctgttggttaaaaatttaacctgtcatttttagtaggaaaaacttcttgcttcccgctttcctgagacccagaaatgtcattagtctgggtgtcctgtttgttttttttttttttttttttttgagacagtgtttcatgctacctaggctgtcctgatcctccatcacttcccaagtgcttgcaccaccactagtgttattctgagctctttggaagcaagattttgcctttttatctctatcccagcatcaggcccatctggtgcccagaatataaacaccagatcaaatggacgggtctcttctcttcaaagcactgttttgttcagctgtagggagggttccagtcacagcacttcagcagcataggggaactatacccatttacctttgatgcctgcattcccttccctttgtggccagtagttggagcaggagaaccagtctgtgtgcagcagagcggaggcggccgagcatttgagaagtgctttgcaggtggacctggcagaggcagagaggcacagggaagccctgtgggagaagaatactcagctgcagactcagctgcagaaggcagaggagtcaggagctgagctgcaggcagaactaaagagcatccgagaagaaaaggaagaacttaaagagaaactaagtgaggtgagaagagaatttgctgtggtcacttgcagtgtaatgcatgcttacggtaagcagaaaggactcagagagtgactcagtgtgagtgaggtatctgcccactgttttaaggaatttccccgactccctattcctacatgatttcccctgaattcttagctagcactgcataattagttcaaacatctacagttctctcatgccataattatttgtttgatatccttgaaggccagcctatgttgtttacttatttattttggtcttttgagacagtgtctaactctgtcaccctggctggcctggaatttcttatgtagaccaggctggcctcaaacttgcagtgttccacctgttctgcctcctgagattattagctaccatgtccagctaaggctgtgtatatctgtctttctgtttgtttgtttgagacagggtgtatttgtggatttttattgttttgtttaactcacaacatgaggaggtatggccatttatagtgggaaaagcatggcagcagatgtctatgtggtagccaggatttgtggcagctgcttgcttgcctcttagccaccagaaggcagagaaaggggaatgaagtgttctgctgggctttctcctgttgtccttttaattgaatctgagactccagcgcatgtgatagtaccattcatattcaagtggttttccctcctccattaacatcctcacagacatatccagaagtgtgtctcctaagtgattctaaatcaccaagctgacaataaagcttaatcttggcaatcttgcttttccctaccaaacctctcattgccttaatacttgaacataatccattcttagagtcccttctcaagtgttagtcactttctcatgtgtatatgggtcctgttgtccctaggacagtatctcactcataggagagcattctttctggcctggggcctcctgattgatgaaggaaataaataaatgcctattatttctgagtcatttcagtgctcatggtgctgagtctagactctctgaagaccccttggtcctgacacgttgttagcagccctgggcatctgcctcactctgtatctcatcagtttcttttcctcaggcacatcaccagcaagaagcagccacagctcagctagagcagctgcatcaggacactgagcgacagcaagaaacacttgccagagcagtccaagagaaggagaccctagtacgggagagggcgactctcgaggttcgcctgcaggctgtggagcgggaccgacaggacctcactgaacaagttctggggctcaggtagggtccacacttaactctaccaagcacccagagctttgcaaggctaagctgagctccctgtcctgagtgcatgatctgtaaatgaattgtagacaagtaattaattgcttgatggattagaatacttcctgattcccaaatctcaggtcagccaaggaacaactggagagcaatctctttgagacccaacagcaaaattctgtgatagaggtcactaaggggcagctggagatccaggttcaaactattactcaagccaaggaagtaattcaaggtgagagcccaccagggtgggcacgctgcattccatggcaatgttcacagccaagagggcaatgggaagctttcctcatccagacttgggtcctctgagatggaagctgctcatgaggggggtgggccgggaaaatattattaggtaaagggagtggcgtggagcagaggctcagagtggatcttgcctgacatcttaggggaagtgaagtgcctgaaactggaactggatgctgagaggagccgggctgagcaggagcgggatgcagtagccaggcagctagcccaagctgaacaagaggggcaggcagctctggagcagcagaaggtggcccatgaggaggagttgaacaggctccaagagaaatgggtaggtagcggctgcccattggggaataggagaggcgacacggcatccctttagtgaatctgccacctgccgctgttggtccagttattactgcttagaaaaatgaaatttgatcaccagggtataaaatccagtttaataatcctcaatcataggtgtggactttgggagcccattccacatagagggatactccctgagccaagacacacggatgggcctaggccctatctcaaaggatatgatagactctgatgacaccctatgaaaagcctcactatccagggggagcaaaaaggatatgtgatatgtagggttttagttgggggggtggtaggggaggacgggagggagaagggaactgggattgtcatttaaaacaatcttgtttctaattcaaataaaaaaaaaatctgcaaaaaaaaaaataaccaaaaaataataataatcctcaatcccagaatgcatgtctctgtttctacttcagcctctgttttctgagataggatacctccttgtggcctagtgggcctcagagttgaacagcttctagctattaaataagttaccatatgaaaaaatacaaagactagttcttggcatagtatgagctcttcatttgtaagctctctctctctctctctctctctctctctctctctctctgtgtgtgtgtgtgtgtgtgtgtgtgtttcttgtttgtttgcttggtataaataaagaattaagtgtggttcctggaagcagccatggcagagcacaactataatcccagcatttagaaccagaaagcctgtgggttcaaggctacctgttttacaaagggatccacacaaagagatgtcaagaactgatggcgtacacctttaatcccagactggggaggcagaggcaggcaaatctctgtgagttcagtgacaacctgctctacttagtgagttccagtccaggattacctagtgagaccctctctaaaaatttatttaaattaaaaaaaaaaaaaagtttggggctggagagatggctcagagattaagagcactgactgctcttccagaggtcctgagttcaattcccagcaatcactgggtggctcacaaccatccattatgagatctggtaccctcttctgatgtgcagatacacatggaagcagattgttgtatacataataaataaataaaatctttaaaaaaaaagttgtaagagagcagtctaccttttaatcatcagggagattgtaaagctaggcaatcagaagatgggattacctgagtgtgtggagaggaaaagagaagggaccaccatgatccaggtgtggccatggcagtcactccttccagggaaactgaagccattagctcatcaatcagaaagtttgaaatagtttttactttgggcttgtcagtgggcattacccctgactcttagagggatgcagccactgtcatctcagcacataattctaaaagtgggcaaacttttggctactatcttgccaacaaacccaccttaaaacaataaataatcaaggggctagagagattagtgcttaagagagtacagctctcaagaaggccctggcgggctcctagcacccacttcaggtgattcacagttgcctgtaaagccagctttagaggtcctgaagtctttctctgacctctgtgcacatatatacatacatacatacatacatacatacatacatacatacatacatacgtggcatacatatacataaataaaaataaatatttaaaaacaaccaataatcaaaagccatacatgatacttagtgtgtgcctataatccagaacccaggaggcaggtgctattctttcagaggacccatgcttggttccctgcacccatgttaggtagttcatgactgtagtacgataagtaaaagacccagagacagatatggagttcaaacttcaagctgaagaacagaaaactaaaagagccagccactagctctcactccctcagactgaaaggtgatcctggctccaccaaacctctggctagctgcctctcctcagcgtagctggagaatcctgagacttaatgtcttcctatcctcaatgtggctggagaatgaatgccagctctgagaccctggccctggtgtgtgataccaggtgctgagatcacctttgtgtgagctatttctctttaggactggatcaatttcgaggagctcagtgtgaccttgaactaacagatctgtctacctctacctcccaagtggtgggattaaaggtgtgtaccaccaccacccgatcactatggcttgtggctgactgctgtctgaatcctcaggcaagctttaataaatcataaataatatgtcaccacacttcccctttttcatctgcaactccagctgcagggtgtcctgtatgcccttctgaatcccaccagttcctgcaagatgaagccagttaaaaattccaaggaggaggaaggggctcctaaggcccaacttctagttaaggaattattagcacttgatggcttttgaaaatcggttctccttccagtataggttcaggggatgggactcaggtcctcaagctgatgcagcaagtgaaccaaagtattctggttatagtctaaccagaagtgatggattattcctgttttgacatcacagaattagctctcttgtggccatacattcatatggagcaaacagcttaattttgttttaggtttctttaaacaattgtcaccattaatctttcacatgtgtttacagttggctttttgaacctgaatgtaaggtttgtcatttacaatgatcctgtggttagcatctgtactactgttctttgtttgtttgtttgttttatcgacagggtctctctgtgtaatagctccgcctgtcctggaactcgctctgtagaccaggtttgcctctaactcacaaaaatccatcttttctgcctcccaagcactgggattaaaggtgtgcgccaccactgcctggcctaaacatcatttttaaaaaaataaatctcacttgactcttaagttttaatgagacagataaggcagggattgttgagcctttcatcagaaatgattgccaggctgagagcagtgcctaaggcacagtgaggcagtggagagattcgcactccaaacaactctctggtctcctctgctcatgcactggttctaacagtatggtttcctccacatggtcaggagaaagagcgctccttgcttcagcaggagctggagaaggccctggagaccctggaaagggagagaacggagctggaagtaaggctgagagagcaacagacagaaactgaagccctccgtgcacagagggaagaggagcgaacccatgctgacagcaccctgtaccaagtaagtggacccttgtgacctttgattccccctggcttaccacttttcattctaacagcaaggctcaagtggggcttccagaagagtgtgtagctaccactttgctgcttgcaggtgggctaatacgcagttagctgcagcaggcagtatgtcatacttcctgagggagggccaacatttaccacatcctgtcagcttgcaaaccagtggcaatctttgcacttcctggttctaagttaatggtcttagacgttcctttgccctcagccttcatcctatttgttggaagaacttggagcaaatgtgcttatggcctcccgggttagcatgataacccagagccgtgaagcccttgcccttcctgcctttccacagatgcaactagaaacagagaaggagagagtctccctcctggaaaccctgctgcagactcagaaggagttggcagatgctacacagcagttggaaaggctgaggaaggacatgaagattcagaagttacaggaacaggtatgcaaggcgctcctgggcctggtcctcctgcctcctcccaaacgccagagttacaggcatggaccacaacacccagttttatgtattgttaaccatcaaacctcaaggcttcatgaatgctggcaggaggctgttcttaattactttatttatttgttctgtgtgtatatgtacatgcatgtgcacgtggcatgaaacgcatatggaattcaactcgtgggagttggttctttccttccactgtgtaggaccctggaattgacagcaagcacctttacccactgaggatagtttttgaaggacaaataggatttcactgtcatagggccctgtagcagacagaatgaggcttgggaaattcaaggacaaaaagaggtgcatggctctggtgtgataaacttgggggtggtacaggagagggggagaggatgggggtggtacagagagagaggagaggatggggtggtacaggagagagaggagaggatgggggggggccaggagaggggggggagggggggggggggggagggggagagggggggggatggggtggtacagagagaggggagaggatgggggggggcagggggggggggggggggggggggggggagggggagggggggggggggggggtaggggggggggggggggggtggggggtggtacaggagagaggggagaggatgagggtggtacagagagagaggagaggatggggggggaccgggggggggggagggggggggggggggggggggggggagggggagggggggggggggggggtaggggggggggggggggggtggggggtggtacaggagagaggggagaggatgagggtggtacagagagagaggagaggatggggggggaccgggggggggggagggggggggggggggggggggggggagggggagggggggggggggggggtaggggggggggggggggggtggggggtggtacaggagagaggggagaggatgagggtggtacagagagagaggagaggatggggtggtacaggagagaggggagaggatggggtgatacaggagagaggggagaggatgggggtggtacaggagagaggggagaggatggggggggtacaggagagagaggggggtggtacagagaggggagaggatggggtggtacaggagagagaggagaggatggggtgatacaggagagagaggagaggatgggggtggtactggagagagaggagaggatgaaaggagacctttttagctatagtaggagcttgggttttgttttgaggccaatgaaaaatggtgaatgatattttaagagtaggagaacatggggggctggagagatgcctcagtatttaagagcactcctctttcagaggacctgggttcaatttctggcacccataaggcagctcacaattgtctgtaattccaattccaggggacctgacaccatggcaaagcaccaatgcatataaaataaaattaataaattaaaaaaagagtaggagaacacattatttttttaaaaggcttatttatttttaataaataaatgttatgtgtgagttttttgcctacttgtatgtatatataccatatgtgtgcctggtacttgcagaggccagaagaggatgtcagatctcctagaactgaagttacaaacatgtggatactgggaattgaatctgggtattctgcaagagcaaagtgctcttaaccactgaccatgtctctagcccctgtgatatatcattttatgtatttaaatacttattcttttattatcattatctttttgtggttctggggctccaacctggaaccttgtaacattttaggcaaatgttcagctactaaattataatgccagcctagaatatctttttgaggcagggtctctgttatgtggcttccacctgtctttgcctccctagcactggcattaaaggcatgtgctgccatgcctggccaggatatcttttaatacagtacttgaccaagtgaaagtatgtacatttatgtatgcaatcaagtgaaaataggggtatgttggggaggctgtgggcctgtctagaagtttgactgagcccatgcaatcgtgtggaagaaggaatagggtataaggatagaggggggaaacaatatgcattcttagtccctgcctcaggtctgtcaactcagtagaatcaaacagcacttatacagcacaggtttcaggagctagcccctatggaagctttttgcactcactgatcctttctccggtaggagaccactgacatgctgcagacccagcttcagggagcacagcaggagctgaaggaggcaacccagcagcacagcgaggagcatgctgccttccggaaggacagagaagacctacagaagcaggtccatctttcctacctgcctcacagccctgctcaccacagccaaaccttcccactccctttgtagacaagagtcccaggtcctgctgcttgagcttgggaggacagggctacagaaataagtgcagagttgttgaagggtgttcagagctgatcatgtgcctcaacgagttctgggattgtattattagccatcgttacccagattctaccaacagccactgaaaatacatactgtgaatatacaggccttttcttattctctaaataacaaccgttttacatagtgtttactttgtattaggtactgtttacattgtattcaatatgagaaatgtataggagaatgtgaataggttgtggtcaaaagctatataatttaatgccagcacttaagatttaagaggttgaggcaggccaggtgttggtggcaaacgcctttaatcccagtacttggaggcagaggcaggtggatctctgagtttgaggccagcctgcctggtctacagagcaagtaccaggacaggctccaaagctacatagagaaactctaacccttggagaaaaaaaagagagagacagagattgagtttgaagtcaatcctagctgcatagtgggattctgtctttaaaacaagaacaggctaggaaggtggctcagttaataaagtacctgccatagtgcattaaggtctgagttcagattcccagcccccacatggaaagctgggtgaggctggagaggcagagacaggcgggtcctggagctcaccatcagctggtcttcctgaaagtaagtagtatcaggtttaagaagacagatcctgctttaaaaaaaaaaaaaaaaggtggagaatgatagaggaagccacacattaacctctgacctacacacacacacacacacacacacacacacacacacacacacacacgcaccatgtgctgggattaaaggcatgcactaccaccacccaccttctcaaccaagatttttatttatggctgcacttatgtagcatttctaagactttggaaacgaacaagcttaagagtttgggggaagggaatgataagaatgtggttgaagccaggtattggtggtgcacacctttgatccaagcactcagagtcatgcaaatctctcagtctgaggacagcccggtctacagagcaagttccaggacatccagactataaaaccctgtctgaaagaaagaaagaaagaaagaaagaaagaaagaaagaaagaaagaaagaaggaaggaaggagaaaggaaggaaggaagaacacacacgcatgttcatttagatagctcagaacaactacaaattgtctactgacctccacaacatgtcatggtatgtgattgagtgtgtacatacacaagtaaatgtaaaaaagaaaacaaaatagtgtagggactagtgaaacctccagaactgtggagatgggccactgactaatatggcttacctgagcctaaacatctagacttcttcttctgggctttgtcatctcagcctcttgctcttaaccttccaggtagaggacttgaagtctcagctggtaacccaggatgactcccacaggctggtgaaacaagagattcaagagaagatgaaggaggttcaggaatatagccggattcagaaggaactcgagaaagagaaagccaggtaagctagacagccagaggggtggcttgccttatgtgtcgtagtcacagtggcactgactattctgtgcaaggttatctcaccatgtctcactctggagtacacgtgtagtagccatctggagtggacatgatctcagcttcagatcttatatttagtaaatatttagagaaaagaccatttatgcaccattgtcttatgacaatgtagtccctacctcaatagaatttatagtctgtgggatttttttttttttttttttttttactcccagacagggtttctgtgtagctttggagtctgtcctggaactcactctgtagaccaggcttgccttgaactcagagatctgcctgcctctgccaagtgctgggatcaaaggtttgcgccaccactgcttgttggaaatttttaatcgaacaattttttaaacaaatggaaagagacaaggtgcagagagagagagagagaaagagaaagagagagagagagagagagagagagaaactgctttagaaaggtataaggaaaatctttcccaggaagttacatttaaactgaatgctaagccagacatggaccctcagtcccagcactcaggaggcagctctctgagtctggccaggtctacaaagtgagttccaggacagccagggctacacagagaaatcctatctttaaaaacaacaacaaaaagataaaataaaaataaactgaatactggagctgtcagatggttcagctggtaaggacgcttgctgcgatgcctgcccgacctgtgttcaatcttcagaagcctcatgatggaaggagaggatccatgcctgaaggttgtcctttgacctccactcgtccctctatacacacagtaaataaataaacagatggaatgttgaaagacaatggagccacccttgtaatcaaagagagttctgttcagtaagagaagaagtcttgaggcaaatgagagctttccctctttggtgatgccagagtgtggaaagctagtattagctaaagtccacagcaggagcttgtaggttacattcaacaggaaactgtaaggatttcaagtaagggaatcagcataatcagatttctggcctgttagaagggatagtgatggcctgaaacatggagtgacatgagcccattcagaatgggagacagcatacgctcagtgacctagggacctgaaaaggaatggatcttttcaatagtgacaactgagtcctaaagacaagtcaggaggctggaacaggtgtccaaatgagagttagcaagactgtgtgtgccatggtaagtaggagggaagggaagaagagaggaacttaagatacattacggcttaagacaattatatatagttatagattggatgtgggtaggatgaagggggaattaaaatggttgtggcttccatgctttgacactgtagatgaaagagccattcacagagccatgggacagagtgagagatgattgggtggagaattggggacacagggatgggaagcttggatataatgaatttgaaatatgtgcatatatatgtgggatttatcagagaagaataaattggagtgaaatgagtcctcatgtatgaagttcctaggagcccttaggtgttcaataaacagtagttcttactgaccctctggtcaccattatggtttctgttttaacaagcagtgctatgattagaacaatccggtgaagtacactctcaccccctgagagaatgacctctctctccaacctttgtttttagcctggcactgtcgctggtggaaaaagaaggcagactcctcattttacaagaagctgactctgttcgacagcaggagctgaattccctgcgccaggacatacaggaggcccaggaaggacagagagagctcagtgtacaggtgctgcactatgcctgagccctactttctggagaggatgctcttagaggggctgggtgaattttttttttttcctaagaacaagataggctgggacctcagcatccctgccagtaggggaaaagcagggctgggcaccaggggtttaggaacctgacacacagatgagctctgtcccatgtggggagcctgacatcctgaacagagtgttcatgcataatcacttgcagatgtacttcatctggttggcaaaatgcagcaggggaacttggagggtaaacaccagcaagaggccttccgtactccatttgttcattgactcggacctgagcctggaggagagacaaagttgaaaaggagagggaaggggctcacacctacctactagttttcatacagtctgaccagctccatgtcaaggtttcagggcagagttctaatctcagcagggctgacatatctgtctgactgggaacagggccaggtgtgttagtgtagcctgggcccttgtgtgtggtgttgatcacccccagttgtcagaactactcatttcagggcccttcctacctgctgcagagctgagcccactggacttctccccatctggggtcctgatggagcttgctcagagagtctacttcctcccggcaggtggaactactgaggcaggaggtgaaggaaaaggaggctgactttgtagcccgggaagcacagctgctcgaggagctggaggcctcacggatcacagagcagcagctgcgagcttctttgtggacccaggaggccaagacaacccaactgcagctgcagctgcgcagcactgagagccagctggaggtactggctgcagaacagcagccagagaaccaggcccaggcccagctggctagcctttactctgttctgcagcaggccttggggtctgcatgtgaaagccggcctgagctgaggggtgggggcgactctgctccctccctgtggggccctgagccaggtgaggaagccacatgagagctaagtcttgtgggccaaagctggggagagggaaaggaatggagttcctgctgtaaaatagcatccaggttaaggccaccgctgattccaggtagcttgaaccccagtctgtttggtagcaggcaaagccacctaacttctcggaacttgatttttcttgattataaaatgttaaaagtcctatcttagaatttgtctaagaatataaaaagaggtaggccaaatggaggtgcctgcctgtaaccctagcactaagttccaccagcctgagctacatagtcagttgtttggggttgaggttgggataggtggattaagagtatagtaaattccagccagcctggactacttaaatcctgtcttaaaaaaaaaaaaaaaaaatgaggctgggcagaggcaggtagtctctgtgagttcgaggccagcctcgtctacagagtgagttccaggatagtcatggctattacacagagaaacctgtctgggaagggaaaaaaatacaattttttttatagcttgcacttttgagcatagctgccaacagccagcattttctaatgcagcagttctcactgtggggttgagatccttttgggggttgaatgaccctttcacaggggtcacatatcagatagcctgcatatcagatacatcacaattcataacagtagctaaattacagttatgaagtagcaacaaaataattgtatgtttggggtcaccacagcatgaggaactgtgttatgggttcgcagcattgagaagggtgagaaccactgccctaatggaaagtataggaataaaccttctagaagggattctttggagagagggggggccagcgggagggccaaggccctgtctggggagggacagctaaagctgctgcttattgtggcagccaggtaagaagtttcccttttcttcagatcagaatggagctaggagaccctttaagagagggtccctcctgaccgcactgtcagccgaggctgtagcattggctctccagaagcttcatcaagacctgtggaaggctcagcaggcccgggtatgtcctctgccctcctccttccttttctggagttcccctgagatcctcaaacagacttgtaaatggagggagatgggtcaaaggttactcatcccgatctctgcccctatcatcccacctgtatcagtgactgtcctgcaaacataactgagcctttggatttcctgggccttgctttcacttcctcagctgtcccactctactccaaaccccagttgctgggtggggcctagaggagccctgagaactgtaaacatgggttttctcttatatcatttcttctcatccaagaatttcttcttggtaccaaatcccctgagaaaaggcaggtaagctggggcgtattgaaatttgaggtcaccacttaacaaaaatattctagacttaagactgaacctacttcacctcactgtgcacttgctagtcagtactgagagctgccagtgcacctgtgcaccagccactcagagctggtgatacagaaatataaagacacagcctgccttcaagaagctctgcatagtggagctgacagaaggaccagttcagacagacagctacctgctgggactggaagaaagtgtcaggggaactgtgaaggagcctcttgggcgagaaggggtgtggcctgggataggatactgagcagttatttcaaaagaaataatccaggtgtagcggcacatgcctgtagtcccagcactcaggaggctgaggcaggaggattgagaacttgagactagcccgagtgatatattgagaccttgtctacccccccaaaaaaaataaaaataaaagatttgggcagataaggtgtggggcctcaaatgtctgtaatcccagcacttgagaggtagaggcaggatgatagtcaggagttcaagacaagcctagattttgtagtcactttaagagcaacctgggcttcatgagactgccagaaataacaacaaaaacctaagtccaaggggtgccccttaggttcaccctcccttctgcataagagtttaaagcagtgattctcaacctgtgggtcgcaagccctttgggtgctgagcgaccctttcacaggggttgaatacccgatagcctgcatatcaggtttttacattacagtttataacagtagcaaaattacaatagcaacaaaaataattttatggttggggtcaccacacttcaaggaacttatttaagggtcacatcgttaggaaggtttgagaactggcttagagagtggggtcatgatggcagagactgcagagtatggatagtctctgagctcctgaaagtgtgagctcagccccgcccttcctctcccaggatgatctgagggaccagatccagaagctgaaacagcacctgactgatacagaggcccagaagagccaggtccactcagacctgcaggacctgcaaagacagctctcacagagccaggaaggtgagatgctcaggggaccaggctgaaaggaggcaagagcaggtggtggctggaatggggagactagctcaggcacctgggaggggcgagcctcttcaactcttgttccactgtgcttggcttttgtgggccaccctggaagaaggatttagaaggaacggacttgggaaatcgatagacgctgcctcctgggctgctgatagtctcttcggggagttgtttttgttttttcacttttaaaattgcacttattttgtgtggggggggggatgccatggcacacatggaggtcagaagcaatttgtggaaatcagttctcttctaccacataggttccccaggatttaactcaagtagtcaggtgtggtagtgggagctttttcccttctgagccagctcaccagcccatgcagggaaaaaaaaaattttttttttcaagcacaaaatcctggtgaccctgggccagaactatcagaacataaaactgtatttcttttgtcgtttatccctgttacttatttttaccattttccactatcacctcaaaattagcctttgaggacaaaagggttgtaaacatactcttgagaaaggccagaaggggactcaggaagagcaagcacactgccatgtccctctgctgagggtttggagggtggggaccacttggaaaggaaaagaggctcaagactgttcccttctgaagttctattgcagaaggaaagaggtgagccttttaggcatttgagaccttgtctaccccccaaaaaaaataaaaataaaagatttgggcagataaagtgtggggcctcaaatgtctgtaatcccagcacttgagaggtagaggcaggatgataatcaggagttcaagacaagcctagattttgtagtcactttaagagcaacctgggctgaggttccgtcttcagactttgagggcctctaggaaccacctacaaactcatagaattggggctagaacgggccactgcatcagctggctctcatgtctggagagcgatctgagaacccctgggtgatgggttctcagatgaagtgtagggtgattagcaggctgtgctgtgccaggactctcagcagacacagatgcaaggctggaagcagctgctggcagaaaagtgatggcacaggacactgggtgtcattttctcctccttggccttgttcccctttgattctgatccctgtcctccatctgcttctgtaccctgtgttcccccacctgcagccatgcacctgactccaacatctctgttcttttcaaagagaaatccaagtgggaagggaaacagaactccctggagtctgagctgagggacttgcatgagactgtggcatccttacagagtcgcctacggcaggcagagctgcagaaaatggaagctcaggtaaagtgctggtctggggaagagtgccttgggaattgtgtttagagttcaagcacctaacccttatcttaaccctaaccctaaaccttgaccctttcctaaccctagccctgaccctttccctaaccataaccctaaccctaacccctgactctgacctttttcctaaccctaaccctaacccgtgttctgcctctcagaaacaccttggcctgtctgtgctcatgcctggcttccttcagcaagtctcaaagttccctgactcttcccaccttcccattattaaggtcatagtgaacctttatttaattactttttctggattaagattagacagttattccctgatgtgcaagatcagggtctagaatgcctctttgcattaggctatctcccctggacacagaagagctctggaaggtggtagggacacttggatagggtcagcttaagtggggcacttcttcagtccttgttaacgactggtcactgatgttgcctcaaaataagaagccagtgttagaatgatagtatcaagaaaataatcttgtccaggcagtagtggcacacacctttaatcccagcaggcaggctgacctgagttcaaggtcagcctggtctacagaattccaggacggccatgactacactgaaaaaccctgtcttgaaagaccaaaataaaaaggaataatcgtgtcttaaagccttttgcctcttgtttccagaatgagcaagagttgcttcaggcatccaaggagaagctgacagcccaggttgaacgtctgcaagcatttgttgcagaagcccatgctcaggcaagtgcggcttctgtcctggaagaagatctgcgaacagctcgctcagcactgaaactgaaaaacgaggaggtagagagcgagcgggagagagcccaggctttgcaagagcagagtgagctaaaggtagcccaggggaaagctttgcaggagaatctagccctgctggcccagaccctgtctaatagagagcgggaggtggagacgttgcagactgagatccaggaactggagaagcagcgggaaatgcagaaggcagctctggagctgctctccttggacctgaagcagcggagccaagaggtagacctgcagcaagaacagattcaggagctagagaagtgcaggtcggtcttagagcacctgcccatggccgtccaggagcgggagcagcagctgagtgtacagcaggaccagatccgagaactggagaaagatcgggagacccagaggagtgtcctggagcatcagctcctggaactggagaagaaggctcaagtgattgagtcccagaggggacagattcaggatctgaaaaaacagctggtgacactggaatgcctggccctggaactggaggaaagccatcacaaagtggagggccagcagcaggtgattgcggagctggagagccagagggaaatgcagagggtggctctaactcaccttacattggacctggaagaaaggagccaggacctacaggcacaaagcagtcagctccatgagctggaaagccacggcacccatctggccagagagctgcaggaaagagaccaggaggtgaaggctcagcgccagcagattgaggagctgcagaagcagaaagagcagctgactcaggacctggagaggaaaggccaggagctgatgctgcagaaggagaggattcaggttctggaagaccagaggacgctacagaccaagatcttagaggaggacctggaacagatcaagcactccttgagagaacgtggccaggagatggcttctcagcggcagctgatgctcgagcgggcagacaatgggcagagccctggtaaagcccagcgcggaagcctggaacacttgaagctgatcctgcgtgagaaggagaaagaggtagaatgccagcatgagcgcatccaggagcttgaggagcacgtgggccaggtggaacagcagctccaaggcctgcacaggaagatgggtgagactagcctgctcctgacccaccgagaacaggaggtagcaaccctacagcggcacctccaggaagccaaggaccaaggggagctgaaagagcaggcacttcagggtcagctggaggaggcccagagagctctggcccagagggaccaagaactggaggcccttcagcaagaacagcagcagaccctggcccaggaggaaagcatgaagcaaaagacaggcgctctgcaggccgctctggagcaggcccaggtgaccctgaaggagcgccagggggagctggaagagcaccgggagcgggcacaaaggctccaggaagagctggtgctggagggaagacaggttcgggccctggaggaggtgttggcagacctaaggtctgagattcgggaacacgagaaggctgtgctggcccttcaacagcagtgtgcagaacaggcacaggagcatgaggcagaagccaggaccctgcaggacagctggctgcgggcccaggccacactctcagaacaagaacaagagctagcagctctacgagcagaaaatcagtattcccgccatcaggaggaggctgcatggggccaagcagaggctctgcaggaggccctcagcaaagcccaggctgccctgcaggacaaagagcagagtctccttgagcaggctgaattgagctgcactctggaggccagcactaccgccttacaagcttccctggacaactgccagtcacgtgccaggcagctagaagaggccctgaagattcgagaaggtgagatccaggcccaggggctccaacaccaggaggttacgcagcagcttcagcaggccctttcccagaaggaagaaaagttgaggcagcaggaggagcagaggcagctgctggaaaaggctctgacccaaagcagtcaagaaaatgggatccaagagaaacaaagtctggagcaagagagaaaagaggacacagggggccttgtggcgagcctaagggagctacaacggactctagcccaaaaagaagaagagattttgatgctgagggaggcccagcaaaggcagagtctagaggcctcttccccaagccacagagccttcccagcagagaagccagctccacaattgtgccaggagttggaacgactgcagaatgccctgaggcagacagaggccagggagatcgagtggagggagaaggctcaggacttggcacggtccctggcccagagcaaggccagcaataacagtctgcaggagatcgctatgctcctacaagcctctgtcctagagcgggaatcggaacaacaaaggctacaggtgagtcactaggaagggcaggggatagagttcattaactgagctcaagggctgcttgcctgtggtacctcagagagtgagaaagtggaggtggtgagcccccccatacctcagagctagcggaacagatgagcaaccataaacagtggggtccgtgtctgataaaggaagttcagtgtgctccaagcacacggggacaccaaagcttcccaaggatggtaccaaatggcttcctggtaaaactggtgtttaaggttaggttggaagagactagtagggaattaaccagacaccatgcaggtgggactttcttgtggaaaggcagaggaaacacgaggaaggaacatatgggggacctgtgaaagagggccaagtcacgtggaacgtagagacacgaggccagcagaagctatggcatccagggctcctaaggactaggtcactcgtgggaagtgggtagaaaatttaggacaatttcagaataactgctcaggatgcgtgtggatcgacagcagacttgaggagacaaaaggggactctggaagtccagggaaaggtggagacttggggggggcgggcaaatgtgaataaagaaaggacaaaggcagcaccaggaatctgcccactgagatgaagaaaagcagggtgaggaggtgaacttggtcggaagtggaatgaggcacctgggggacacacaggggacattcctgtaggggaaggagtgtggcgcttgaaagtcagtggttgattatagacggttgttctcaacctgtggatcaaacgaccccccagacgcacaactcctggggcctcctcactttctgggaactcacaaagctctgccctggtaaaaaggtggtgtgtgaagaaggaatcacactcacaaatttgggggttgggttcctagatttgaaataggttctgtaatttactggctgttgtctatttcacttttcaagactgcatttcttttttttcttttcttttctttttttttttttttgttgtttttttgtttgtttttcaagacaagatatctctgtatagctctgactgtcctggaacttgctctgtagaccaggctgactggcctgcctctgcctcctgagtgctgggattagaggtgcaccacacctgaatacgtgggaatgatggtttcaatgaggctgtgtgtagcaagtgctttttaacatttatctatttgagccacatgtgtagaggtcagatgatagcttgcaagagttggatctctcctttcgctatgtgggtccccaggattgaactaagatcatcaggctaagtggcaagcatcttactggccatggaacttatcatcatatagcctatcctgtggcctagcagaaggggggcacatctctgggcatgaggatacttcctaggcttgctctcaggttactgagtgttctttagataacataacaaagatcagaggcagctctttgtggtggtcatgcttttgttgtttttggggtttttttgtttgtttgtttgttttttgagacagggtttctctgtgtaacagtcctggctgtcctggaactcactctgtggaccaggctggccttgaactcacagagatccgcctgccatctgtgtgtagagtgcctatgcaagccagaagaggatgttggattccctggagctggacagttagaggcaactgtgagccatgccatgtgggtgctgagaaccaaatttgggtcctctggaaaaacaacaagttctctttaccacttagcattttacatattttatatatttttgcatgccaggttccattgttctcactttttcactaccctcaaagaaggaactgatattatgtccattttgtagttgaaaaatggcagtttgagacttgagcttatccaaagtcagacatctggttgaaatggttagctctgacatctgagtagggctcaggattagaccatttggctcttcctttccctgtgagcctgtcacacgtgtgcgcgcgcgtgcacacacacacaccacaacacacccctcacaccaaacatcacacactctcacatccggctccattcttgagcacgattatgaagagtagaggatgagatagttttggacatgagtttggcgtagtgtgatttttgtccctcgctctgtaccctaggaggagttggtgcttagcagacaggctctggaggagcagcagtcacatggctcacattcaaccagcagagcagaccgggggcccaaagctggacaagatgtacatcctggaaaggtgagctgggcctggtggcataggaggagccctgccaacagtgtgttccctccttggggaatgggtctctgaacccaagctcacaaattggtccctttgccctctgtctcttctccctgtctgtctggatgcccatatgagtaccatgggtcttccctgcaggtagttgtggctgagcccagtcctggggtggaggagaaggagcagtggacacaaaggcttgaacgtctgcagcaagcagttgcacagctggaatttgaccggagcaagctgcaacaccacaatgcgcagctgcggattaccttagagctggtcagtaacttctgcagtccccgtcctgtgcctgtttctgaaacagtttattaaattacaccatgctttctctgtggatgcctactcatcatgctggggagcatagtagttgacatggcaggaacagctcaggaacaacccacaaagctatcctctgctcccagggcctgagagctggcctgccttctctgtaccaggagcacttctctgtaccctactgtatgccctccccagccctctacactcacccctgcacacgtgctggctccagatcaagacgtgatttctcacttgcatattggcaggtagagcgagaacggaggaagctgaagagggattccatgcgtgcttcccgagcagggtcactggagatgaaagaagctatggcttcgtcccccgcacagcaggttaccctgtttttctcacctgcctctttcttcctgccactatagaagctcaaccctctgtagtgcactgttgtatgtagagacagccactctatttaatctagagagccccttctgggttgattctgcccgttgtctgtccttgccttaggaggaggtccagcatcagtgagtaagcacagccagggatagtgggttcagatcactcccaggccagtgcctcacattgccctctcatccagagcctctggcatccagggctatgtcgtgcttaccagctcttgacacgcccaggagtttgagcacagctttgtatctaagagccccttagttctgagtttacaaagttagggttctgatgtgtcctggcacagagccccattctcagggaaaagtttgctcttttaaaccgtcaccgcctaaggtaaactgtgcccatcagcatggcaggaggaacttctagtcctgaacatctccagcttcaccccacttcctttaatgaacgtttcccaggggcagatactatctttcttccccttcggcccaatgctgccacaaaccagatcccttatgttaaataaaagagttcctcacagccgggcgttggtggtgcctttaatcccagcactcgggaggcagaggcaggcggatctctgtgaattcaaggccagtctggtctccagagtgagtgccagaataggctccaaagctatacagagaaaccctgtctcggaaaaaacaaaaaacaagttcctcacagaagatgctgcttgtggtgctgctgtgaggccctcttgggccttccctctgcctggagccatgccccacagtgcttcagtctgagttcaggtactcctggccctcatgatgagctagacccctgcgagggggataaggagttcagcaccgccttttccacagatagacctcctggaggcctcgccagcctaggagcacaggtgggggtaggatgctgtggaaactccattctaacaggagccatatctgttttcctcaggatgggagagcagctcagaggggttcctcggatagcatgcgtgtggttgaacttcagagagaggtatgttctggaaggatccatttcctattccccttttctctcactgtactcaggcaacaggttcagtgtctgcatgtccagcaggagaggggaagcagctttggcactcagagaactttgatctccataggagacaaaacggtgctccagtcccaactccaccttcagtgtggcaggaagtctggggagaggagactcagagggtctagggcagaatggggcaagcagcactggctggcctggccctcccttgtaggcagggctgtggacaagcacactaggcagaggcactcagacatggccaggcaagctgccatgctcaggaaactactttaatgcctcctgcctcctgtgctacctaaagagtccagaagcctcttcttttctcctccttcctgctccctacacctgtcttcctgtcccacctaggagtaatgagaagtatagatttgacttctgaacctctctcagaatcagtagttattgttggcaggctgactccagctggacttgagctatgctttgtagtctgttaaatttctacgaagccccctgacacagagtctgaggcaagagaagccttgggactttcgttttcccgtgtcctagtttcattgataaacacccagacaacagcaatggacaggaaaggggttattttagctcacaattccaggtaccagtccatcgtagcagggaaggcaaggctgccagaacttaaagcagctagtcacagcacagtcagcagctgggagagaatgcatgcatgcctggtacttagcttactggagtccaggactcaaagccaaggaatggaaccaccggcacaaacaagctgggtcttcccacattgtttatgtagacaaagcagtccctcacagacatgcacaggccaacctgatgtacctagtcccaggtactagattgtgttgacagttaagcccgctgtctttcctgtggagccagtgttgagaatcactggatttggagtccatgggacccttatcccaactccagtgcctgattctgagattcagatatgaagcagttgatcccagggtggagccacaagccacgagagcacagagcagaagggccaggacagcctcagagccttcagctgctctccttcttggttttcctgtccaccaggtagcgctgctgcgagcccagttggcattggagcgaaagcagaggcaagactacattgcacgatccgtgcagaccagccgcgagctagcaggcctgcatcacagcctgtctcactccctcctcaccgtggcccaggcccccgaggccactgttcttgaggctgagacccgaaagctggatgagtccctgagtcagagtctggcatccccagagccagttctgctacatcccagtctggacactgctcaaactacccccaggtagcagccatagccagggcagaacataggccagtaaggtggtgcacattggacaattgcagaggggtcacagctccctccctgcaacaactacaggtttgccaaaggcaagatttaactctgttacccaactaggaggcccgggtcagctgatagtcccaggaagaaaatgggaaggctcacatgggaatgaggcaaatcacatttgcttgctaacctcctgttacccaagaagtgccttgccctgactatggggcatctgttgtctttctgcctgttgaagcaagcacagtctacactgagcctgggccctgttggcaccagcagcacagcacgtgggtcctctgtcctggacaggagcatcctcagagcatgaagtgcagggaatgtccactgccttcttggcttcagtgtatccctccccttccccgtcaacaataaatgccaggccttcgccttcgtcctcggctgctgtctccacttctgcagacaggcagaagcaggacaccaagtgaatcgaggaagatgctgcgtggtgtgctgtctaactggggaggttacagaggaaaatcctggtccagcttcaactgtgactggtaagagccatgtaacaagtctgacaagatgcttggcacttgctgccaagcctgacaatatgagttctgtcccccgtcccacaagatggaagaataaatagccctctgacctccacacatgttcgatagaacctgcccctacatatacatatgcatgtaaacaaaaaaagaaccaagtaacacattaccgatttagagacgtgtatgagcagaagtcctgtggagattccaaggagcgaggcatcaccccctgacccctgagggatggagttgttgagagttctgctaaacacgtggtgggaacgagtctatctgaggcaaagggtggaccaaggttagaggctggattacagcaggcctctagctcctacccagacagtaagcatccactgtgtttctttacctaaaccaagctctatgacttttggctaaagccacagtcttgattggagaagtccatgtggcttctttccccataacacatggttgtctgaatatcctcccatgtcctttcctgggtgcatctcctggaaatgactctggcctctaagtcccaccatgtatcaagcgagtcagcacagaaagggcctggtggatatagactagagctcacaggcctaaggccattgttggtgacttcctcaaagcctaaaaggagtagtgccctgcatgcttcctctctctcccttcctcccgctgttccttccctctcccctctcctctccctcccctacccccccccttgaagtgttggggatagaactgaagacgtcagggttctgggtatgagttctaccccaagccatgtcactgccctacaccaacttcttgttcccagatagagaggcttgagcctgcagtgcatgtgccctcgtgctttgtatttttgacagttaagtcattcacatgtgtgtgcctgtccacacacacacacacacacacacacacacacacacactgtatgtattggtattccaatccaatttcatcttttagtatgtgcatatttttctagttccctatactgaagaatcagtcccctctgaaaacagtgaaactaacttgagtttgatcatgctacttagtgtaaatacagtgagccaatgccttttactggggttacttatgggcaaggagtattaacagaagtagaaataacccaaagacagctgtgtcaccaaaagcccaccccacatgggtgacactcacaaatgctgaacactttagctcactgtataacttgcaggcagctccacgggctggagactcttcctagcagttcaattgatctctgcttccttccaggcagctaggcttgtctgggagtggctctcagtaggcctcactgcttacatatacttatggagtgaagggtctagtgaatctgctcagtttttgggacttcctgaagcttttgagttgggaagcttccctgcaggatggaattttcgcctctccttagaaccccctgtgtcttcctccaaagtgaaaggttttgtcttgtaggaaaatgctacataacactgagcaaggcagtgcacacttgtaatgccagtcctcagaaggcatttcgagaacatcatgagttcaagatcagcctgggctacactgtaaaattctgctcaaggcaggtggatctctgagttcgaggccagcctagtctatagaactagttccaggatagccagaggccagagctataggggtcggggatggaggtgtcagaaagacaggcaggcattgcccctgggatctgacccttcctccccaggtattatgtttacagataagagaaccagaccaagattttattcagttccagactgatctcataccattttcttttgatcttcacccatgaatgtcttcacagttatgtggctgttatgatcctaaaactctgcagcattcatgcctcatctgcctgtcacttgtaaatggcagccttgtctggccatcccagctgacaagcgtcttccgtttgtgcttctctagtccatgcagacaggtcctgggggctctggtctgattatcgtaatgggaccatatactctgctgttctggtccaaatccagaaagggtggcctagcatgagagggatgtgcatgtcagcaggctggatcctgtcctttagcccttgttccctcttccatcatctagtgacaggctgtttctagaactgggagagaataatagagcttcccttctctagggtcgacagactgaacacagtgcaataaacactctcatagacttaccttgaacctcaaaaagaccatcaactagctaatctctgttatgccccgggaaggggattccagacagaagaaaggccctgtgaaaaggcaaaaggcaactagagcactagggaactgcgcaggggctggagaggtagcttggctaagagtactcactgctcttgcagaggacctgggtttggttctcctcagcacccacatggcagctcagaaccatccagaactccatttccaaggaaccaaactcccttttctgacctctgagggcactaggcatgaacatagtgcccacacatacgtgcagtcaaaatactcctatacacaaataattttttaagaaattgaagtgcagaatgggatacaagaaggcaagtgagtgtatgctcagagctttgccctccgcgccgaagacgtcagggaatgtggtgagtctgtgcgggccatgcagaccagactgtgaattccagcattgacactcagcctggttatccagctggttgcccgtgttatagttgtatctgggctagcctgcatctctccccacagcagctcagagatgcatgctccttacctcatcttaactagctcgtgcctctagggaaatcagactgtctcccaaaatctacagttgagaaagaattggagatggtgaaatgctagaaagctcctgagacctaagaaaatccctcagctgtccccagcgttcctcccatcttcttaaggggaacccccacacctccacactgagagtatttgggacatctccattaccttgtcactcggggcgccatctccacaagctccaggagccactgctgcctccaagagccctggtgactggcattcttgggacagattaagggtcctgtggtttggctcctcaaaactgcctcagatccgtgggtggtgtcctgactcatcctgggaacaatggcaaacattgacagaacctcgggataagcctggcccgggccctgctaccttctacttagtaccaacctgaaagccatgtagaattggttggtattgctgaggccagagttccccagcatggcacagggcacacagggaaagtcaaaatggtacaggaggggcctggggatcacttctgatagctccttccacgttttttcaagcttgcttactgagttcatgccctggtaacagcagaaagagaagtcggggttctggcaccagccatcagttcgggggtggggaccagggagaagcacacagcaaccaagagaagagggttaggataggaggtgagctgggcatggagaagacagtgagtggctcagggcccagtcctgaccactgaccagccaccagaggccttttgtcctcctcaaataccccatggtcttctcataatatgcttcaaaccagttccattctccagctgtgtggtggcaagtggagcagttcggggtccttgaaaggcagccactttccccagatctgaagcacagccagttacagtgctgtggtaccatgtatgtccattcctgctggggtgctgatccgtgtgtccaatccaggtagggagccatcagcaacaagacgagcccccaagagacccaacaggactccatatctggcccatgcaccaggtcatgtggcagacagcagactggggtctctacctgaaaggacatggggctgaggctatggacagtgccagcatcccttcatgctggtctccacagttccccggctttccttccagcttcaaccttcccttcctgtccattttctcacccccagggagcgttctcactggacctagagagaacataaattttatcctcagtgctccctgcagaaggaaatgacaggctgtcagggccactccagttgtatcacagtgcatcacagagtccacattgtgaccactgccctgtagcctgcctggggaaagtctgcagcctctctaatgctcaaaagtgagagccctcggctctcttccactaagatgcctgagatctctcaccagaacaagcctgaggctgaacttgtggttttccctagaagccaagccttgcaagacagtaaatgacccaccatcccctgctgctatggtttcagtgatcctccaaaatgtcttagatttatgtaatgacactctgtggcctctaatacatagatgcacatactatggtatcaaaaacttcccagccgggcggtggtggcgcacgcctttaatcccagcactcgggaggcagaggcaggcggatctctgagttcgagaccagcctggtctacaagagctagttccaggacagcctccaaagccacagagaaaccgtctcaaaaaaaaaaaaaaaaaaccctcttccctaacaatggaagcaacgggagcaaggttttttaaattgttttacacttatttattttgggggggggcattcattccacggagcacgtgtgtggtgatcacaggacaacctgcaagagtcgggtctccttccaccttgtgagttctgggaattgtcagaaattgtcagggttagtgacaagcacattacccactgagtcatctcactgccgccctgcagaacattttcatttgctcagaacagccagtactattgatgtaaaaggaaaaaagcaagaaaccccaacaactctgcattgaaaatcaatatgttaagcttgatttccatgtagttattcttcacactagaaattaaacaaggcccatatgtgtaaataattataaaacaaaacagtatacttcatcttctagacaagaatgccaaattcatttctctttgtgcaaaaccaattgtagcctagcatgttagtgtaacttttttttccccagcacttgggaagcagcagtaggaagatctctgtgagtttgagactagtttggtctacatatggagttccaggccagtgaggaccacaccctgtctcaaaaaaaattataattaaaagagctgactcagctgggcagtggtggcgcatgcctttgatccccacactcgggaggcagagacaggtggatctctgagttcaaggccagcctggtctacagagcgagttccaggataggttccaaagccacagagaaaccctgtctcaaaaaaccaaaaaataagaaaagaactggctcagtgggtaaaagcacctgccacacaagcccgaggacctgagcttgatccttcagtgaggagaccagatttatctcaaaccacggtctacatcctgctcacatccacctccaggagtatctagcagctggtggatgtcattctagttctgtggcttgtggatcagctgccaggccctgatagagctccttccacaatgtttatgtatgtgggtgtgttgcctgtatgtctgtctgtctgtctgtctgtctgtctgtatgtatgtatgatgtacctacaccatgtgcatgcagtactcatgagggccagaagagggtgttggattccctggaactggaggtactgaccattgagggccaccaagtggattctgggaattgatccccgggtcctctgaaaaaagcaaccatggtcttaactactgggtcaactctcaagctcctatacccatctttttaaatgcaagttctaaggatcaaactcgggtcaaatagttttgtgttcctttttttctgcagttagacctgagaatttacatttacagaactgattcctatataggtatttagtttggctccagtgttttgcctctaagcaaccccacgaactcatccttatgcctttactacctcgtacatcttttatttgttttgagatgagttctcacagcccaggctgaccttgaactgccttgaaattatgattctcctgcctgtaccttcttctaagtgctgggattacaataatcaccatgactggccttcctttcagtcttttgtttttgttttgttttaaaaaacaaggtctcccaggaactggagagatggctcagtggttaagagcactggctgctcttctagaggacctaggttcaatccccagcaccaacatggcagctcacactgtctaactctagttccatggaatctggcatcctcacatatatgcaggcaaaacataatgcacataaattagaaataaataaatttaaagcaaacaaggtctccctacatagcccaggttgacctcagccttgcatccctctgactcaatcactgcaaatggcctgggaaactaaaatacagaacaaaccctatacctaggatagtttggtgatcagctttgctcaaaggaggtgcagtgtgtagtgctcagggggaacaacagactcctaactgaccaaagtaccaagaataaatgactgttgaatacccagccataaatgagacagccatattacaccctccaaggctcagggaacattttggaagatggggttgagagaatataagatctacaggaagaagggagagcagtgtggaattgtgaattccaggcatgacaaggcatgacatggtagttgtacccttgatctcataagagctcagattaggggctggagagatggctcagtggttaagagcactggctgctcttccagaggaccggggttcaagtcccaggacccacacagccgctcataaccgctcgtaattctagtttcaggagacccacaacttcacatagacatacatgcaggtaaaacatgaatgcacatgaaataaaaataaattttttttaaaaagagctcagattatctgcacaaaatctccataacattgggccagtcaacaccagaggatttatatgcacagaatggttggtgagagaagcagagagatttttgtgagtggttgaccacatgaacacacaaagtcatgaaagtagaaggaaagtgaaagggattatgggtaactgtgtgtgtgtgtgtgtgtgtgtgtgtgtgtgtgtgttagaaatacattttatatgtatgaagatgtcataatgaaatccattattgtgggataatatatgctaataaaaaacatttaaaaattaggtgtggcagtacatgcctttaaccccagcttctgggagtcaaaagcaaacagatctctatgaattcaaggccagctagagccacatagtaagaccctgtctaaaataaaataatacaaaataaatgcttctgggtggtagtgcatgcctttaatcccagtactctagaggcagaggccggtggatctcgtagtttgaggccaacctgggttacagagttctaggacagcagggctatacagaaaaacctgtcttgagaaagaaaaaggaaaactttttaaaaatccttagatggaagggaaactattcaatactatgggtatgtaaccactcaacagcataaaatgggattcctaaagtgagatttatgacctgaagcaggaattctaaatcaaaacctttaagctcagggctggagaaagagctcagtgtggtttctgctctttcagaggcccctggtttagttcccagcacacacatcaggtgactcacaactgcccataagtctaattctaggggatctaatgccctctgctatcatccagtacacataaactcatgcagatacacatacccataaaaataaataaataaataaaccaggcagtggtggtgcaagacgttaatcctagcactagggaggcagaggcaggaggatctctgtgagttcaaggccagccttgtctaaagggtgagttccaggacagcctgaactgttacacagaaaatccctgtctcaaaaaaaactgcatacatacatacatacatacatacatacatacatacatcttcaaaacaaaaacgtgagatgccatgaggctgaggcaggcagtgtccaggagttctaggcctgtctggacagcatagggagactccgtctcaaaagaaaactcaggagcattttgttttagtcaccacagctggattaagccagggctgctcctctacagccaatgggttacaagaggaagcaactctccactctatagcctaggcctggaggggtggagcatgtggatgaatttaccgcattctgaacaatgattttgtgttaacccagaaagcactgggaagctgtttaagaaccgagggtactttgaggtccagtagaacaaggttccattactgatcagattgtgcttgagaaaaatggatgctaacatcatttttttttttttctctcccgagacagggcttctctgtttaacaaccttggctatcttggaactcattctgtagaccaggctgggctcgaactcacagagatctgtctgtctctgctcccgagtgctgggattaaaggcgtgagccaccagcactggactccactttcttttaaaaagtctttaaaattatatttacttatttgtgtgtggccaccggcgtgccacggcattcgtgtgggaggttaaaggacattttgcaggaatcggttctctccttccgccacgtaggcctagggatcgaacttgggtgataaggattggcagcaagtgctttcagccgctgagccaactagcccgctaataaccactcctcaaggcacacattctcctgccttaaccgcattggaaacacctcgatgccactcttggactttctgatgcggtcggcgggaaccaattatttgcacttggagccaattctaactcatgctgctgcgggggaacgtcggaagcgctgtcctaacaggtcctaaggtcccaggagacgcgcttaccaccggtgctgccactcaagcgccgccctctgttcccggcccgcccacctcgggacgctgcccaatcctcgcctgggaacgtgacaacgcccacaggtcagacagcctgtaagaaggcaggtaaggggtggagcccgcgtacgcactgctgcgcctgtgcgcgacagcgaggggcgtggcccagactccaggccggaagcgggaggctagaggggcgggccggctggtgtcccctttccggccggtccccatggaggcgctggggaagctgaagcagttcgatgcctatcccaagactctggaggacttccgggttaagacctgcgggggcgccaccggtaggtctcggagcgggcggggttgtggggagggagctgtccccgcgtttggcccgggctccaggactctccctggcctgctagaggctgaggggtgggacacaggccattccaaagctcgctcccgttctgcagtgaccatagtcagtggccttctcatgctcctgctgttcctgtccgagttgcagtattatctcaccaccgaggtaaggggcgtggcctcggtcgtgggcggggcttagcgttctaagggtaggaccctgaaagccgggatgggggtaaggccaaatctgactgaggtggtgtcgcgccaggtgcatcctgagctctacgtggacaagtctcggggagataaactgaagatcaacatcgatgttattttcccgcacatgccttgtgcctgtgagtacccgattgtaggtgggggggtgttcaggtgggcttccagatacacgcctctggccttagatcccggaatggatgccatgtcatcctcattcccctagtccagttcttccacgagatacatccttcctatcaaagctcagatctccaggttcctggagtcatagtccgtctctgtttccagatttaagcatcgatgccatggatgtggccggggaacagcagctggatgtggagcacaacctgttcaagaaacggcttgacaaggatggcatccccgtgagctcagaggctgagcggcacggtaaccgatccgagagccggacatactcgcactgccttgtgttagtgggctgctgcaggctcagtgacacattagaagtcagctggcttgcctagggttctccagctgtgaagagccaagagtcggttgaatccgtgcttctcatatgagcacattgagtggaataccttaggagttggagagatggctcagcgcttaagagcagaacacttttcttggttaccatactctcaagcttaagcaggggtcttctttgggtaaaagcttgttgtgtgtttaccttcccaatgcattggctaaagtactttccccctttgcaatacaagtggcctaaggttaagagtttcagttctcaagtagaactgccttgcaatctctgagtagcaactgtaaagtagtggtaaacagtagcaccccatacatgagataaaggatcagaggcagacagatggttcccagctgaaggtatgagagcatacacattcaacctttctgctctcctctttcagcagaggattcagtaagttattcggagataactcagtacttcgttaggaaatagtttctctgccagatggttttgcccagctgtaagctgtgtatgtattctgagcgtgtctaaggcaggctagattaagctatgttagatgtactaagtgcatttttttcaagtaagatagcttatccacatgtaaccccatcataagttggggatcaacaatgtgtatgaaagacctggtatagttttcactttcacttcctgtttctaagccgctgtctcttaccctcaggtccatttccttccccctctctctctctctctctctctctctctctctctctctctctctctctcgacaggttcttgatagggtctcactatgtaagtcttgctggattagaaactctatgtagaccaggctggccacaaattcacagaaatccacctgcctctgcttccccggtgctgggattgaaggcgtttggtgtttgctattttcctattaatatgtagtgcatgtaaagtgcttcttcacacctgactcatggaatatattgtataaatactagcttttcattttttgtggtcaaaggactcctgtgggaaccagggttgtagatgtcactgcgtctgcttcatgttgtgcttttgcctctgtcctctccttagagcttgggaaagtcgaggtggccgtgtttgacccaaactccctggatcccaatcgctgtgagagctgctacggtgcagaatcagatgatatcaagtgagccaggccctgggcatggagtaggttcttatcagtcactgtgattagctagccgcagccgtgttcagaccgctgggggtaggatgtgtacttcggcactgatccccattcatatgataaggttaataagcaggcctggcctgacagctgcagatcgaggcacacggcataagaggatggtcactgctcttcagcctagagaagcagtttaaaggttgtctctgacttcggttatccttgtgttcagtccgagccacctcacttctctattaataacagaggctagcaacaccttccttgcaagagtcacataaggattaagtgtgtgttgtatgtaaagccctgaagtacaaggccaaagccacaagcctctgatatgtgctaacggctgtgtggtttcccagccctgacttctgagagactgactcaataggtttaggaagatctacttttttttttttttttttttttttttttaaagggaaaaaattgggggaagtaaagggaagaaattggtggaagcaagattgttaccattcagtgccaaacaggcacaaggccctggaatccacaggaccacacacaatacaataataatagtggtacatatagcctaaagtttgcattttaaccattgttatcatacaggtcattggcattaaggacattcacaatgtagtgtgagcatcactaccttttctcctcggagggtcacagccccaagccacagaggaaggggtgtgtgctctgaatactgtgcccaaactgaggagacagtgagaacttggtgaccagagaggaggctggcagagcctctgcagcagacaactgtctgggctttcctgcccagggtgccagcccttgctgtgctctcaccctccacgtccacacctcccgctacaggtgctgtaacagctgtgaagatgtgcgggaggcataccgccgtcgaggctgggccttcaagaacccggacactatcgagcagtgtcgacgagagggcttcagccagaagatgcaggagcagaagaatgaaggctgccaggtgtatggcttcttggaagtcaacaaggtaccaggagggaaggaggcaagacgggctgggctgagccaggctgggagaactccacagttgaagtggagaatgagaggaaatatcccctgcaggtggctggaaacttccactttgcccctgggaagagcttccaacagtcccatgtgcatggtgagtgatccagagtcggccaggggcatttagctctgggttccttcttggcaggttggcatgcccctcactgggccagtgttctcttagctttgagccacagtaggagagcagtttagcacacttgtgaagagaatgggggcagggtatggcttggctggtagagggcttgcctctgtgaagccctgggtctgatccccagcctgtgtggtgcaggagttaggactgtagcacagagcctgtgtaagtgctgctttgtttaagtggtagcccccccccatcaggtgactgtgtgtgaggctttgggtcagcaaagctggattggaactcaggttttgtgctcttgagctgtatttatgtatgcattcgttagatacctagcgtgttagtctagatatagatacagcagtcagtaaagtgcctgcactcagaatattcaaacagacgtttggacctggtccacatacctataatctcagcacttgggaggtagagacaggttgtcctcatttgtataacatgtttcaggctagccttagccacatgagaccctgcctcaacaccctctctccaccaaatatgaaaaaaaaaggacaggtttataaaatatgtgatataccctctactgttaagtagtgagaccaggcagagcctggtctacagagcaagttctaggacagctagggctacatagagaaaccctgtcttgaaaagaggaaaaaaaaaaaaagagagcaatggagaccaagcctagcatggtgttgctcacctttaattctagcaattggggggcagagacagacagatctctgagtttgagaccacctggtctacatgattagtgttaggttagccaaaactacatagtgagatctgatctctaaataaacaaacaataatgtggaccagaacaaggcagaatagagatggttgagggacagagcatctgctgtttagttacagtggttgaggaaagactggggtttcacttgctcaaagagctgagcacagtgaagcagccagcagtgttgatgtccacggcagcataacaagtagagagggcagtaaatatagatcctaaaggcctgagtgtgcttggcaagtgcctgggacagtaagaaaggatggctggaacagagtgagcagatgagcatagttgactacaggtgtgcggacagctgcatagggcccgagggaccaggcttctgtgctgtgagacgctaagaagggctttcaggagggtgtgatgtgactgcacttaaaaaagtaaggtcaagcatggccgggcagtagtagtgctcacctttaatcccagcactagagaggcagagataggtggatctctgtgagttcaaggccaacctggtcttctgagagagttccaggacaggttccaaagccacagagaaaccctgtctcaaaaaaaccaaaaaataaaataaaaaaataaaaaaggtcaagcatggtggtgcagacctttgatcccaacactcaaaaggtagaggcagggggatctctgtgagttccaagccagcctggtcagcataagttgttccaggtcaacctggcactacaagtgtattacagggtctccatagtgagaaggctggaggacgaaaggacagacaaggggcgtcagtgaggagttctgcagtgaccaggcctggcagagaacgtggctcagagtggtggaggtggagaagcaactgggttctggatacgttacaggtagagctgagaagagctgatagatgtgacagagaaggacaaaggagtccaagatgccttcagagtttatgcctaagtagtggaaagattggaactaccatttaggagactcaggaggactcggggtggggtggttatttgaaagtaagtacagagcagatatctagactagtaggattctcatttcctaggccctgcggatgccaaataagtgtttgcctggagttcaaggacagagactagccaagagacagacgttgaaccctcccacatatttaaagctatgggactccatgcactctccctgcaggtgaactttgttggagaagggaacctgagtactaccaggcttcttgtgttagaggccagcggcatggggctgtaaaggagactgtaaggatggctggtgaggtgggagcttcagccaggagtgtgccatcctaagagccaagggatgggtactcctggataccaagcaaaagatgaaggttggttgttagtgtagtggtcgttggtggccctgacagaacatgactatgactagaaatgcagaaaagtgtttaagatttgcattagagcaccaggtgctcgaaactgaaactgcagatgggcgccattactaccacgtcacggactagagcaggggttcccaaccttcctaatgctagtaccatttaatacagttcctcgtgttgtcatgaccccaaccataaagtgatttttgttgctacttcataactgtagttttgccactgttatgaattataatataaatatctgtgttttccagtggtcttaggcgacccctgtgaaagggttgctcagcccgtgaggggtcacaaactgcaggttgagaacgctggtttagaggatggcaacagaactggagactggggggcggaggacaagactgaggaggcgtgtccaggaactggtgcgcaggctgtcagatggctcatgtacagggctgtgacaagggctgaagtgacacagcgggtctggagaagacagtctaggccttgagcgtgtggaaagagcaaactccagccatggcaggggagcagaagcgctcatgcagtgtctctcctggcttcttctcgggcagaggaagcaaggtcattagcgaaggctgtggagaaagggatggcatgctggaggcaacagggggacgtctttggtttcggggacagtgggtggaagtgagagcacctgtgggattttctggggtttagtgttgctctgtgctgcacagacaagggagtcaaagagtatacaaagaggcaatcacagagctggaccatgggaggaaagtgaggactcagggtttgggggaggagtagacgccaatgaggaagcggagaagcaccagactgccgcaggcctttggtgtggtggcaaaggatggttggatttggggcactgcggggccagggaaggaacaggaggaagttagcaagctggcagttggagcatgaggtgcttgtggttgacactagagaaggtatagctactgctaatgtcagggttagggaatggtcaccatggtggtctggagtgggagagaagagcagggaggcggggctgtccaggaactgggatgacagggtgttggaaggctcgtgtacatgactatgggactcaccaaaagctgagattcgggtgccataaaggatgggcaggtagttactaaaactgtcctgggggtgcctggtggaatttcatgattaacaagtagggtgccttgaactgcctgggagctaaggactttgactgtagatcaggggacagtggtctgaaaatggcaggaaggagctagaaggacctctctcttgactacagagtggataggtatgggagaccaaacagtagttgagacgatggaatggagctggtgcctggaagagaaagtcaggctgcgggggaagcagaagagtgaagggccaaagtggaggctgaagatgctgctgctacctggtggggtgtgggtggggtgagaattaggatcatttgggagatcgctaccagccaagaggattccagaggacaagcaggacctggtggttctgagctgctcccagtgactaaggtgggcgggcgtggggtcctgtagtctctcatgtagtctgtacctgcagagggggaaggcacaaggagaggtaggtggcctggaggaccctgaagagctctggaacccccacccacccctttactctggaggaggccgagtaaaatagatttcctgagaccataggacgacatcggtgtgtcactgtgtgaagctgtggactacaggccttcagacactcgggagggggctgctatcacaacagcatttccgcctgcacctctgcttaggtctaccttctgggtcatggaccccggggcagctgactctgagtgcaaggatgctcatacacatatggctacagtggcccgtggcccaagatctgccattgagtcctcagagtgcttttaacatcctgttggttgcagggtgaacaacaccagggggtataaggtcttgtgaagttgaccaagcatctgcccctcctagaccctcaggtcagcccttggcagacaacaccggccaagtgctctgcccaggtcacacagctgggggaggacttcgaggctctaggtctcattttgttcttaggctggctgtttttatgcttcagccctcttttatgcctctttggtcctggaagaggccttttagctagggctagaccctcgtgccaaagcaggagtctccatcctccccgctactgtgggtcttgctccatagatcccactggagctctgaatctctgttctcttctcccttccccatgctgcagttcatgctgtggagagtaagtggccctgcccccaaggatgccctctccccacttccaaagcagcctgccctcctggaatggggggaggtttggatgggtctgggatagagccttctgaccctgccgctgggtgacttactcctgggatgggctttgacatggggttcctaacagtgggcaattggggttaagatgggaagaaactgctggttcaaaaatccctttggggaattttgagggtagaatcaagggagtccctattgatgttggggtacagtaatttgtcagtaactctggttagtgagagacctgtccgtgggttttgtttcctgagataaaagcctggccgggaaatctgtgttcttgtccaccccagtgggaggctgggaaccctttacccaggtgcagggcaggctctggccagctgtgcttaagcagggccagcgtatcaggctgtgggtgactgaggggtcagagcgtcatatcccacagggaggagtacggcctgaaaaaagactcaggaacctggtcctgcctgcctggtgactgttttcttcttctcctagttcatgacttgcagagcttcggccttgacaatgtacgtaccaggcggaaaccatggaggatgggtggcaagagactggactctgctcatgtctgaaatggggagaaatcactctccatgttctgctggtgttcagacccagggcagagatcgttggacgggtgcaccctcaacagaaggaagctcagagcaaagccaggacagagtgtggcatttctaggaagctggcagagttggcagggtcgaggccttgggactggagccacactgaggagtctgccttttgagaagaggggccacttttgcctcaccttaaccaggggtgtgacatagttagatttacatttctaactgtccctcaaggaagctgccagttggggcttctggcttagaccttcatcccttgaggtgtgcagacaggactagtgtcaccatgtacaatgtggctgcttgaagctgtaccttaaaccctagagcccagaaatctgtggactgaggagagatccctaagtgaaaacaagtgcctggtacagacacttctcctattaaagccatagcttctcctgtacagggccgcttccttcctccctcttcccacctgcgctcacagccttggggaacactctgctactctagctggttttgtgtgggttgtgtgctattgggcctcagacagatgctgatgttgtgtgggtatgtgctatcgggcctcagacagacgctggtgttgtgtgggtgtgtgctttcgggcctcagacagacactggtgttgtgtgggtgtgtgctatcgggcctcagacagacgctggtgttgggtgggggggtgctttcgggcctcagacagccactggtgttgtgggggggtgtgctatcgggcctcagatgctgatgttgtgtgggtatgtgctatcgggcctcagatgctgatgttgtgtgggtatgtgctatcgggcctcagatgctgatgttgtgtgggtatgtgctatcgggcctcagatgctgatgttgtgtgggtatgtgctatcgggcctcagatgctgatgttgtgtgggtgtgtgctatcgggcctcagacaaacactggtgttatgtgggtatgtgctatcgggcctcagacagacactggtgttgtgtgggggtgtgctatcgggcctcagacagacgctggtgttgtgtgggggtgtgctatcgggcctcagatgctgatgttgcttacagatcaacatgactcactacatcaagcacctgtcatttggggaggactatccaggcattgtgaaccccctggaccacaccaatgtcactgcaccccaaggtaccatcctgggaggtagccccctctaccgctaacgcccttcctggtgcccatgccctgtgcttgcttctcctcacagcctccatgatgtttcagtactttgtgaaggtggtccccactgtgtacatgaaagtggatggggaggtgagtcgagtataggcgtccagttcagcttgttgtcaagctctcaaagtcctgtgtgtcattactttggcccggggaatgaggtactgctctcactcctgtgtgatggatgcagagctgaggctccagggtactgatgccctcgtgggagacacacactagacactatttggtcttcctgcctcccacactgcctccagacagtccttgggtgcttactgaccccattgtctgtgctgacctgggggttggctaggccaagcctccttgggcctgctctgttctgtggtctggaacagctgtctttggggtggtgtgacagggctgaagggcaaggatgtgagtcctagccttagggtgctgcctgcaagagtttcttctcttccctgtactaccagtgaaagtatccatcagatgtagctaggacaggcaaaaactgataagatggtggactggaagggaaacaaggatggtccccaggccttgtgttgctagttaccaactgggagcttcattctatctcttcatatagtcacagcctgacaagaagcggggctcagaacaaccctgagccaggttataaacctctctctgcttctggttcccttcttcctgcaggtgctgaggacaaaccagttctctgtgaccagacacgagaaggttgccaatgggctgctgggtgaccagggcctgccaggagtctttgtactctatgaactctcacccatgatggtgaagctaacagaaaaacacaggtaaggagtgggagtggcgaaggctctgagcctgcgagagcagggtgcctactgagccccccttgtgccctgcaggtccttcacccacttcctgacaggtgtgtgcgccatcattggaggcatgtttactggtaagtcccagagtccctgtttggggagcagggtgcccaggcttcccgtgctgtgtttgggcaggtgttcccccactgagtggcaccctcagcaatgccccaggctttggttggggaagaggggaaccttaagggccaaggacaatgctagcctggccagttagatggcaaggcagggtccacatgaggggtccagtgctagccctggtctctcttcccagtggctggactcatcgactcgctcatctaccactctgctcgggccatccagaagaaaattgatctagggaagacaacgtagtcatcatccttccttgtcattcttcctttcctctgttcctgtgatcactcctcagccttcactaccccatattcctcctctccagagtcagcccagggcgataaacattgtgatactattgttgctctcagtgtgattcttgggatctggctgaaacctaggaacagcgccccctcacagccacatgaggtccatcatgactgacaggctggggccaccccccttttggggtcccacatatgcgtctcctgtttaatatggcttcacagccatgtccttagtccctcttcttctgtgactgaatagaatgttctagggtaaatattttggaagccaccatagcttgtggaatagatggctccagtgccattatcccagagctctgagtccaggctggattgtgtcacttctgcagtgatggacagctaaagcagagggggcttcccacagcctggactcagtcatgtggtccagctctctgccaagccccatagtgtctcggcattgagaaaatagacctttacagactcctaaatggaagcaaaactgaaaaacagggagagaggtggcactgccattttggagcacagccagcaccagatccttgactcaggacccaactggggcttcttgttagagcccttagctctgtgtagagaatcgtggcccagaggcctcactgctccacagcccagggagtcaggacagcggacagcagtcagttcatcagctcttctatttcccctaatgacagcaaaacctccggagggtgcctgaggtccaggtgatttgatcacctgagagttgtcaatatcactgaggaattgagggagatggccctttggtcacctggggaccgtttcccttgttaaaccgggcaacctacccaccatcagcctctgtggttccagaggaaggttggtttaccccatgcccttaggaaggtcaccatctgagtaggccagccaccagacccaagataagccaggcccctctgaaggagggagagatggagctgcacagtgctcctccagttccggggcaggctgtctgcaactgtcctctgggggcagcaacagccagtgataccatttaagccctatgacaagctacttgaagtcagccaaccaaaacaataatttccctttttgcttaagccaatttgggttgagatttctttttcttgacactgaaagctttagcagacatccttgctctcggggttggtaaaaagttagtggaacaaagtgcttaggtgtcatggaaggtagagccatgagcagattgagggcaaccagcctctggttggaatagaaagcatgctgcgggggtggggggttacaggttgacacagtgcacttaatccttagggcttgttcttttctggggttgcatgtggacagtcttcgagacagacatattgactataagtttattataagggccggtagaatggggagactaagaagaggaacaggggtaaatggctgaccgccatggccggtcgccatagagagacagagcgggaaacagagaggggacagagagagagagagagacagggggagagagagagagagagagagagagagagagagagagagagagcgggaacagacagagagcgtaaaggtgcaggggcctatcttttaaaggggtcctctgcacctgcgtgcagacttctttcccatggaaccttgggctgaccagggtattgcctgagtggattccaccaggtaacaggggcaggccagcataatgcctgaacctttcaccaagtactgaatcctgacagctcacgttggaaggaaggacatccagagcagggttgaaaggttggctccctgagctgtgtctctggtcccttggattagtgtttgtggatggggctgaagatgacctcgctgatctgtccaggaatagtgtagaagacgaggagcaggaagacagtgatgagcgcaagcagcagcagcagcaccaggatgcgccagtaccggcgccagatgaagaagacgaaagtcttcagggggttcacaaaccaattgaaggaggttttgggacggctgttggggaagggtggagtcacatgaccaggaagcccctgacagcggccccgcctccctaagctccgctacttacttgggcttctccagaggctctggctcttttctccccttcccaaccggccgcttctctgcctcctccacagtcagtagttcaaactctgcctcaaccttcccctagaaggagatggtggggccatgagtggacagagcccagccctgagccacgtcgtggtcattacactacgcaccgtgaggatgtagacattgccaccggtgtctgtgaactccaggtcttccggccgtcctttcctcctcctcctcctcttgcgtttcttgccagcctgagcctctcgggcctcccgctccacatcttccatttccctcgtcttcactacaggccaccagccccgcagtcgacggcagcgaaacagattgcatctcggcccagccccatcaagggctagtcgaacagaacactgctcagggacccgggcccccctcaccatgtctggtagctgcaactcgagggatcctgtgagagcaaaactcacgaggttagggtaaggggtcaaagagacagcaccccagagttgcaaagtgccaaaagggagaatgcagccaacggtcagtccacagctatagacttcctaaccagtctagctaccagcaggtcccaactggaggtccaggaccctactgccaaagcaaggatcaaaggccataatgggaacccagagcgactgcagaagggtccagggggaggactgagacagagccttgggtagaaaggttactagccaggctgcggtggcgcacgcccttaatcccagcacttgggaggcagagacaggcgatctctgggggttggaagtcagcctggtctacagagtgagtttcaccacaggctccaaagctacacagccaaatgctgtcttggaaaatcaaataaacaataagtaaataaataaataaaggaggttgctttgcagcactccctgaacaccgtgattaggtagaaaactatgtttcacgcttgggtctaaaatcgaccacagggctcaaagtttgcttagagtaggaaccaagggacagagaggaaagggtggaggcaaggcaaataaggacaaatcaaatgtaggcttgaggctagaaaaagccaagtaccaagaaagtcgttggcggagattcggtcaaagtcccaaacctgcagcgccagcacagccggctgccggaactcagcctcctccagggcgaaaggtccaggcttccgccggacgctcacctcccgctccgtaggcaggtagtcaaagcgaaacacaaagcgccaattgaagttgccctctccagtcagggaattgaagtggacgtctgtctcctgtttatcatgctccagcccctttacccaactgggtgaggaaggacacaacccaggtcaaggtggtgtcagggctggggccacacccagaactcagctctctgcacagagggcctgaacacagggtccccatttacagtttcctttagacagccatttggtgagccggcctgcaagcctaccttttcacatagatgtcacttgacatctctccagtgagtgggttcacatcatccagaaccacatcttccgtgttccagatgacaactcggagctcatagctggggacacagtggtttccgactgttgagaagggtcctgggagtgtgctggcctaacactacagtcctggtttgattccccagcaactcttaaactggggtggtggcacacaggattgtaaatccagctgctccagaggtgacagaaggagcacctagagctcatccttgaggctatatgaaaccctgtccccaaaccacaacagccaacaaatcagttcagttggtagagtgaactaccatgcatgcacaaaggtcctggggtcaatctctagcgcacatacatggcaaggtgtagtggtacatgcctgtaatcccagcaatggagggttagaggcaggaggatggagagagttcaaaagccatccacagctgcataccttgttcagtgccagctggttctacatgataccttgtctctaaagacaaagggggggacagctgtgcaaacagaaaggaactaggtaggtgtcactgaccccttccctactactacaatggcaccacaaggcatggtctaacccaagccagtacaatgaggtgtcagaagctgaaaactttgagtggttcaacatccaccagctgcagggttagagccacagcaagccacatgctgtgcaacgcacagtgctggggtacagagaagtgtgaattgaaaagacaaccagagatagatgtttctggttcttccccggtacggccccgttgctgtcatggggttgcctggatatctcttcatcccttcatttattgattctccctggttttgtcttcttcagataaggtctcatgtagcccaggccagccttgacctctctatgaagcagaggctggcctctgaactcctgatcctcctgcctttgccttctgagtacagggatataggcatacactaccatacctgttttccctagaattctacccaaccacactatcaatctatatggttctggtgggaaggcatctacccaactccaggtttgggagaaccacccagaagtagccaatgtgaggtatcccagccctgcccatagtaactgattcagagaagagcatctaacccctgccagtcagtggaagtggctctgggcttttgctttaataggattgggtatttatttctgctcaagagtcctggctggtaagagatgagtccggcacccttagaagttaccttgttctttgtggactgcaaaaggctctctgaatggctagagggacaactcagtgattaagaacacttgctgccaccaccacctaacttgttgcggggtggtggtggcgcacacctttaatcccatcactcagggagcagaggcaggtggaccaccgtgagttcaaggacagcctgctctacatagtgagttccaagataggctctaaagctacatagagaaaccctgtcttgaatacccccggccccaaaaaagagcacttgttgctcttccaaaggactccacagtgtggctcacaaccatctgtgactctggtttctgtgtctgtatgttacatatatgcttggggcctgcagagatcagaagagggctgatgtggaccagtgtctgagtgtgacaccctcacagagctgcacttgggctagctggggtagaacagggtttactgaaagacatttggactctttacgatacccaacgctcacagattatggggaagaaagtgtaataactcacctgcccataggcctgagtcagaagtcttggcctgacttagtgggagctcagattttcagagagtagaggggccaaaattctctcacctgattggctgacgaggcttaatgtcaactgggggcggggcaggcacatcactggggaagatgtcgatccacatatgaagggatccctgagagcacaaaaccaggctgcagggtcatgctcgagaactcttctctctacagccttgcatctggtggctgccctgtccccagtggggagaagggacaggggcaggagtcatggggtagatttgggggtattcaaatgaaggtagtagagtctgaaatgagggtcccacagtcaaggccaggtttgggttcaggaagaggcggttccagagtgagaaaactgaggtcaagagtaggttgtggtcttgaggcccagaccttagtgaatgagggtggagctcagatcaggagccccaggtctcacgcttgttggctcagggttggggatcctgtaggaccagggtgtgtgtgggggggggctggatagtaagtacagcctgtaacagaggttctcactgacaccagaagcagggtcagtggcggtgtagtgtgtgggaagagggcttggggaaagggtggtggtggtggtggggtgtctcaatgagtcttgggagtctgaggtcccttcacctgcagcagccctgggctccgggggtggtacaggggccgtgtttccacatgttcaggtaccagctggatcccaaatcctggcatctcctgccaacgccgaagcacaagcaatgcttgggcctcttcagaagcctcatttgtccccttgggatccctgccatctgaaacaagaggggtgtggacttgggttcaccacagtccccagctctcctccctcctcagcacctctagataaagctggttgtctatacatggcgtggtggtttacacctttaatcccagcagagttccaggagtttgaggcaagcctggtctacaaaatgagttctaggatagacaagactatgtagagacctccttaacaactatgtccctcccccagacaaaaagtctgtggcctgcagcctgggagagcaagtccaccattcacaaaaagcaaggggtgggaggtggggggtggggggggagggtgctgctgctgtcactactcctgactgtgaagagccagcagcacctttgctcaagaccctgtctagagacgaggccaccagccatttgaagtgtgagctcaattccacagccacagactgtgtagagctctgtatcctgtgctctgaggggtctacctaagatcatgttctcccagcagccaggagctttgcccttactcagacaaactcacaaacatccctgggcctactgccatcagtgggctctcctgggtacactagcccaacacctgctgtgtcctgtgtctcagtctgcctccctcatactcctcgtggcctgcccagcacaaagggtctggtacctgaaggcagggcctcggacggtgtcaggaagactctggtgcccaccttgacagccccagctctgtattcaggagcagggaggccacagcgctggcacagccccagcagaatctgtgaaggccggaatgcatcgcgccaggcattgtacccatccctgcaggcagaagaggaccatgcatcagctagggcagtgtgtgggcacaatgggcacagaggttcaaagaggtcaaatgacttactagtaccaaaaccccaataccctagctcaagtcttggctactgagctaagatgtctttcaaggggtgggagaagttctcctgtaaaactataatttgtatacaagaatggggatgtggcagctggagggaggcaactgttcagtatgtagagggcttgttgcataaacatgaggacctgagttcaaatcccaggagcccacatgaaagttgactcgtagggcaagtgtctgtaataccagcacttctatgggagatagaaagttcaaggagactttgaaagttcatgagccaggtagcctggctcacaacagtgaggagaccctgcctcacacaagatggaaagagatgaacaacacccaagtctgtcctcagaccttcccatgcatgttgtggaacatgtgtgcccagattctcacacatgaatatactcacgcaaacacattcaaattataataagattaaaaccatttaaaatggaaatgtgagcttcaatgtgtttcatgaatgggccctgccagactcacacatcatactgtgaggctagcccacagttggctctgtggtggctataaaatctgttctccaggtcaatccgtgtctccccaatgaggtcatcagagcccaccaagtcatgatcgaatatggccacagtcagctctggctcggctgggagggaaacactcagctccaggaccctggccaggaaggaaaagtagctaaggacagttccatgcactctgatgggacctggagtggcagtgtccagccccccaccatcagcaagccaactgcctaggccagagcatttggagcccaggaacccccaattcccaagccagggcccagcctcactctccaaagatggggtggagttgcttggggatgtagcgttccttagtgtcccgctgctccttgccagcgctcaccaccacataggggtctgccttgccattggggtctgcaggagccaagttggtagcctagggggggtggaattcaaatatagtggaatcatccttgaagcctaagcccttgtggaacctgattacaggattttatgagctgctggaggtcaaatccaggttttcctccatgctggtcaagtactccattgactgagccacaccatagccctggctcttgttacactgtaagagataaatcagtacaggccatctgcagtatgaggtgtgtttagaactcactggggaagtcagagacgcagggagcattagggccctatcttccccagccagcagtggttgcctatctggtgttaacagttcagccaagggttgaaaagttggaaaaatctcctatgtgactcagcccatagtatgggccaataggataaggtttggggaggggacagtactagacactgggaagattatactgccctaaagaattcagccaaagagaaccgcaggctcaggggatgaggggggcaatgtgctggggatctgttagtcttcatgcttgccaagcaagcactctacctaccaagccatctcccagccctattcactcttgagacagagtctcaggtagcccaggcacgtcatggctgacgataactttgaacttctgaccttcctgccttcacctcctgcgtgctgggattacaggcatgtgcacacttgctttgcatgattctggggattaaatccaggtctttgtatattctgggaatgcactctacaaactgagctatgtctccagtccttggctggtcttgaacttacagtccttctatcttagcctcctaagcagctgggattacagatctgtgctaccaggcccagctcgagttgtttttgtgtgtgtgtttgtgaggacattcgtatgtgtgcatgtatgtggaggtcaaaaagtgacttcatagcctcagatgttcctcagagtcctttttttttttttttttttttttctgagacagcatctctcactggactggaacttgccaagtaggctagcttggctggccagtgaaccccagcagcctctctccacctctccagtactgggattacagacatgagtggccacaccagcttgtttggccctttttgtttgcccccttgctttgggttgttgtcttgtttggcttagtgaggagttttgttttaattttattttatgtgtatgagtgttttgcctgcatgtgtgtctatgtaccatgtgcatgtttcaggcaggggccaagagagagcagatagatctcctagaactggagttacagatgcttgtgagctgccacgtgggtgctgggaattcaatctaggacctttggaagaacaaccagtgctcataactgctgatctcctctcaggccctggctggtattttgatcctcttgcctccatttcccaaatttggggattactgatgtgcactgcactcagttatggcttggggtttgtttgggttttggggttttttgttttgttttgttttgtttgtcccactgtataggccaggccgacctgaaactcactatatgtagtccaggctggcctagaattcacagtaatcttcctgtctcagcttcctgctcagcctagtgctggggatggaccccaaggcctggagcaacactttggctccagtgttctgagcttctgggctgtcatggtgcacagctttaatcccagcacttgggaggcagaggcaggcagatctctgtgagttcgaagccagcttggtctacagagcaagtttcagggcagccagagctatacagagaaaccctgtcttgaaaaataaataaaaaaaaaaagtgttctgagctaaagctgggctcccagaactgaggttttctggattaaacagataatattaatataaatcccagtcttaaatcaatgtggggggcacactaaagacacattccccaggaagacactgtttccctgaaacagcctccccttcccagtggacaagctgcctctcagactctctctcaaggaggtcctgcttcatgcagggtcttgtctccagccccctcccttgtcagactctaggaacccaaggccaaggtggggacaaactaagctgagctctggggcacatggcccccttggaattactgctgccacctcctcactcggggaacaggaatgcttccctttcttcagagctttgtgttcataaaaacagtctttgtctgacatgtctcaatgtattacaaagtttatctcagagcatcctgcctgccatattgctacaacacacaggcaggatgagtcccactccctagcagtaccctaggaggactgtctcttccagtgatgtctcagaatccctaggtcaggccgcagcatctgctccagggacagagggacagggatacagggacagagcaacctgcttattccctgtttctccccaagactcctttaagaaaattccaggaccctgctagtctctgcatgacagccatagcaatggaaggaactacagggtatttgacaaaaggcattcaggatttggggatcctccactatagccttcggctccccctggccccagaccaaaagtctgcataaggcctgccacaggcaagctttgtgaggagaggaagtctaatcacacccaagatttctacctaaacccagaggagccttcgagagcctttgtagacatcaggctgttgcctctgctgccatggggatgagctagggactaaggacactcaccttcactacgtacactctaaccagaagcttgatgggccggttctgggggatccccctggagatctggggttcagagaacgatgctgcctctgactcaggataaatgaggaaggagccctgaagtcggggagacaggaaagcaggaaaggagttggtaagaaaggtgttttgttctgttttaaattacattggatttattttatgtgcgagtgttttgcttgtgtgtatgtctgtgtgagcttggttcctgagaaggtcagaagtgagtgtcagattccctgaaactggagttagggatggttgtaaaccacgctgtggcactgggaatagaaccacgatcccctgcaagagcagccagtgttaactgctgagccacctctcagcctgtatgaaagcttgtcccttgtcagtctcccattcttcccccaagtataccttgaatttgcccaccaagtgtccagaaccttcctcgccatctccagcctggccgccttgccctctgtacagggggaacacattcagccagtcctcaaagtggttaaactcctcctctagggagctgttgtagatctgaaaggtgaggggtctcagtgacaactctgttccccaaatccaaggggcacccttctccccaacaccttgtcaccttcaaggtggcgattgctttcttctgaggtccagacactttgatatcagttcttccctgctcctgagcctccctgtccccagaaatgaggtgggtcccgtctggaaacagcagaaatggtccaggtaagaatgtggggacagggatgggtggagagatggagcaagaacaaaagtcaggactctcacctgggtccccagcgtcctccatctcatcctcatcaaagccggactgaaatcaaaagacaggtcggaggtagcccctcccactgccccccttggcccacccctcttcttcagccacagtcacttctttttaaagtcccctctattgtctaaacctatgctgttgacttcagtcaccaccacccacccacggtcactgagcccttgaagtgaggtcagtctgcactgtgaggtggtgtgagtgggacacacagcagacttactgtgagaatgtaaaatagcatattactaatttttatgataatcactggttggaacaatattttgtatacattaataaaacagtaccaaaaattattctcatttgttccctttcactttttaaatgtggctattaacaaaaattaaaataaaaaaaatttgagacagagtctcatgttggtataagctggctttgaactcctgacctttctgttaccacctcccaggtgctcactggagaggtgtgtgtcaccatacccaagtttaagagctaaaattctacactcatgttttttgtttcagagacaggtctcactgcctgttatatagaccaggctggcctcgaactcacagggattgatccagtgcagggattaaggctgtgcaccaccatgctggcctcatgttctttttttttttttttaaggatttattgtttattatgtatacaatgttctgcctgcatgtatgcctgcacaccagaagagagcaccagatctcattatagatggctgtgaaccactatgtggttgctgggaattgaactcagaaactctggaagaacagccagtgctcttaacctctgagccatctctccagcccctcatgttctattttattagagcaacagagtgttgggaggcagaagtactaatgtccaactactaaaattgtggtatagaggagaaaagatgtccgcaataaagagctctgggacacacagtggtcttgtttgatgagactccccaccttcttgcctttcctcccccagttcctgccctaggttgtgctgtgcccacctgcccctggagctccatccacctgcccctggagctccatccacctgcccctggagctccacccacctgcccctggagctcctgcagtgaggcatagtacttggaccaccagtccatctcttctgggtctgggatgtcctcctccagctcaggaccttgacccaggagccctaaggtgagcttcttcagaggagcctgaggcagagaggaccttgttgctctcagtcagcaccaccacaaaccctgacatccccctctccagcctcaggaacaccccatcaccttcaggagccggctggattgtcctgctttagccacgaaggggtccccagactgctctcctggaagtagggaagttattccatgagtttaggccagtagaaatcgaactgcaggccccactgggcggtccactagagtgtctctaccagggtccagaggtgcttctatctggtggcccctatggagaaagactcctaaccttgaggtccctttggagtcaggtctcttgtatcctcctctatttcctcctcctcagggggatcctcatggccctggagtgtgaatcgcagcatatgggggacaatatgggaacccacaaggacagttcggccaaaggcccggttttcaatcaccaggatgctgagtgggggctgcaggtatggctgttctggtaagtcctagggaggggaaaacaggaagtaactccaaacctgggggggggtacaaagtcagtgggaacaaggcattctgggctcagatctgccacacagtcagtcattatggccttctgactctctgccccagctgaagaagggacacagcactggactcaacagactgttctaagttcggtgaaacaactgagacacctacaaagtgcaaccagaaacacagttagcattgttcttacagggtaaatgctcagcctgcagagagagtgtcagaaccattaaaatatgtatggaccttggacaagtgattccctgtctgtccctggtaccccagagggatgaagatagtgattcttattatatacaaagaggagaaggaatagagctacaccagagaaaaacatctacctttcccttgaattattattagtttttaataagatgctatgtagccctggatggcctgaaacttgctatgtagaccagactagcttcagagttgttatgattttcctgctgctgccttctgaattctgggattacagaagtgtgccaccgtgtcctaaatatgagaaataaccatagctgtgtgtggtggcacacactgattccctgcactcaggaggcagagactgatggatctctggatctttgtgagtttgaggccagccccgtctacagagtgagttccaggacaaccagaactacatagtgagatcctgtctcaaaaaaaaaaacagaaaatgagtaataatctgaagtaagtcgtgaaaaatcagtactcatgttgtgcccaagtcacaaagacccccagagaccaccaggaagacagacccaccaaactacaaagcaaggttttattgattgttcatccaaccatgacaggcaccccgtctggctagccaactcagcagcctccagagggagcaagtttcctgtctactgctaagttttaaagacaaaagtcagccgggcgttggtggctcacgcctttaatcccagcacttgggaggcagaggcagggggatctctatgagtttgagaacagcctggtctacaagaggtagtttcaggaaagcctccaaagccacagagaaaccctgtctccaaaaaaaaaaaaaaaagacaaaagtcacaggattacatcagtaggtatggtttggtttctgattggttgacatttgggaacaatcaggagaatttctcaaagtcatattttggcatgaaatacctgtgtaccaattattctcattggtcagtgctgagagggaacattctgtggtttctatggctttgtcttgttacttgcaggtggcctgttgtacacagatagcaatagttttcagaactgtatcctggaaactacaggggaggttttggtctcccctggagtttcttttgtggccaaacagttcccaggaaccaagtatctaggaggctggggagggggggtctggagtttctttgtgttcagttttagccctaggctctgggaggccagaggatctgggtttccccttgtgtcagaggcctacatgtcctttctgtagcctgtcatggctgctgaagcaggggctgagtgagggtctgatcccttcattcctagaagtgaagcctttgagtttagtttacacctttcaagtcacacttgtgactgtttctcaactggatacaacctagactctcctaggaaaagcgtctcagtgagggactatctatataattaccagagacaatgagggccattctacagtggtaagttggaagctaaaacaactgtatacaaatacacacctaacaacagaatccaaaataaagtaagaagtgacagatgaggctggggacagtggccaagaggtactgagcccgtctagcacgtgcaattcacaaggtctaatactcagggctgaaaaaagaagcaacagagctggagaaacacagaacaacttgagatttcaatgccctaatattgataatggacagaagaggtgtgggaaacactgtgaagcaacttgacccgactgatggatctacaggccactgagctcaacgggagggtgcactcacctcagatgcacagtgggaaaagtggggccaccccatctgaaccttggaacaagggatgaaagggaagcccttagtatagtctcaatgtctatgttcctataaacacatcacttagagggagcaaagggtgacagtattaaaatagggtctttgatgcccaaggtgtggtggcacacacctgtattcccagtatttggagtcatgggatacacgacaagtttgatgccagtttgagctccatagtgggtccttgcctctaaaaaccagaaacaagattggtcgtttggttgtgtgtttaatttttgcagttccttatatttcctagatattaacccccatcttaagtagatagtttgcaaaaattaaaaaaaaaaaacaaagaaaaagaagaaacaaatggccacaacaacaaaaatgtgggttgagctgggcagtggtggtgctcacacacccttaatcccagtgcttgggaggcagaggcaggcggatctatatgagtttgagaccagcctcctccaaagccacagagaaaccctgtctcgaaaaaccaaaacaaaaccaaaaaataaaaaataaaatgtgggttggtattttgtctgtgcaccatgagcatgcagtgtcaaaagaggccggaagaaggcgctggataccctagaaggggaatcatacacaattgtgagcagccatgtgggtgctgggaattgaatccaggtcctctgaaagagtagccaatgctcttaactgcttagccgtctctgcagcctcaccttaaagtgttcaacatccttagccattaaggaaatgcaaattaaaactactttgaaatttccatgtctccccagtcagagtggctatcattaagaaaacattaagagaagtagttcagcacataaaagtgcttgctgccatggcagatgaactaaatccagtccctactgtcccatggtggaaggaagaagcgactcccacagattgtcctcagactggcacaatgcccacgtgggaacacaaacacaatttaaaatgtaataaattaaaaaaaaaaagtaacaagaaatgctggcaaggatgtgggcaaagaggaacccttatttaatgctggtaggagtgtaaatgggtacagcctccgtggaagtcagaatggagatttatcaaaaagctaaaaagtgctggcaagacggctcagtgggtaaggccctcgctgcacaagcctgatgactgagacccagatgaaggtggaaagggagaactgactccacagagatgtcttctgacctccacaggggaaaggaggagaggggagggaaggggagggaagaagaggggaggggaggggaggaaaattctgctttggacctaagcatggcagcccacagctgtaatcccagcattcaagaggctacaccaggaagatctaaggttccaggccatcgtgggctgcataatgagaccctggctccaacaataaaaagtaaaaagaggacagaatgacgaatctcaattaatacaaatgatttttctgaacatggtagcagacacatttaatcccagcactcaggaggcagaagcagaagatcttcatgagttcaaggccagcctgtccacatagtgagttccaggccaccaaaactaccacatctcaaaataaaacaaaatcaagaggacagatgacttgatgaaaccctaaattgcattggtagaatttgacccccaaacccattcaaccataactgaaactaccaagagtgaggaagcagctcagcggtttggtaccagtctccatgtgtaaggctctggcctcggtgctccagcactgcccctcaaaaatcattagacctaatcattttttacaatacagcgtatttcacattttaaacatatattttattttacattgtgtgtgtgtgtgtgtgtgtgtgcgcgcgctcgcacacacacgtgcgtgctcgtgcgtacatgtgtcttttggggggtgtatacagagtacaggtacctgcagaggccagaagtctaagagacccctggagctggacctgatgtggatctgaagagctgtgctggctcttagtggttcagccatgtctgaaggccctgtactgttttttgaacattcaggactctggctaagaccttccattcaacagagctgagagaatgccaccagtctacagattaatccaggtcagggaactacagccatgattcatgtacctcccactgccagtttgtataagctttatcagaacacagccatattcatttctacaccgtctattgctgttttcatctacagtggcaaagttgaagagttgaagataagaggccagaacatttggagaatgctgctcctgaatccgtaatgtagccagctggaattcactacatactgcatccttcaccttcactcctctgccccgcagcctgtgtcctggccccctccttaccaccgtcacatgctggacaagctctgtgaagttagggctctcacggtagctggccagaacttcagactccacacgtctcccagccacttccagaacaacctggggcctttccacctcaaacaggtgtatacgacccaggcctcgaagaccccagaacagcacctaagtttgggaaaggagagagattcaagggctggaagctgacacggtgccacctggttgggggaagggaaaaggcttgttacctcaatacggaactccctgagcacagggcgtacgttaggaggcaggctcaggtgtccagtgatgggctgaaccagagatgccagatcctggggctccacatcactaggcactgtgggctacaagaagaaataaattagaattcatgccacaacacagaaagcctaggcttggagatggaccataggtttctgtggtggtttgaaagacaatggtccctaatgggaggtgtggccttgttgaagtaggtgtggccttattggaggaagtgtgtcgctgtgggggtgggcattgaggtctcctatgctcaagctacacccagtgaaacagttcacttcctgttgcctgtgagacaagatgtaaggactctcggcaccatggtagcctgcatgccaccatgtcccatcatggtgataatggactaaatctctgaaactctaaggcacccattaaatgttttcatttataagaaatgaaataatattgtctcttcacaacaataaaaagcctgactaagacagtctctgtgaagtacaaatgcaggggagccagacaaggctgagtgtataggaaagattttccagaaagcagatgggtgtgtacagaaagccgtgggggagcccgaggcattcgcaataggtaaactcaggatgaacagtagtctgggttctctagggtagaattctggcaagatgaaccttagatatatccatctgtaatcctgggtgtgcaatgaagtcaccccaagataaccctgcagccagcattctcttgggtaagtgactagacagttatccttggggcaccctgagtctacacagcctgatgaataagaatggatacaacttgctagtcaggccagagaattctaacctcgaggtggcctctgtagtccagctcaatgagttcaaaggtagcaatgacttctccagcagcctgtgatcccttcctcagggggaagaactgcagctctgggcgctgatatgggtcttctatcagctttacccttggggctgcaagtgccctgcccaggaacacagcagggccctgtaggaggcaaagcagtgaggaaataaagatgatataactggttgtggtggctacatctttaatcccagcatttaggaaacagagatgataggttctatgatgagttccaggccagccaggactacacagtaagaccctgtctcaaagataaatgtgggaagataaaaatgctcagaagctaaggggagcattcaagggaagaggaggctggagaggggatggagggagggacacacttacaaacttattgtggtcaaagacgttgatgaccactagcggaggctcctcctgcaaatgctcgcgcctgccatccacaatcagctgctcaaacaccaagagttcatcccacagggggctcagtgtctgctccaagaccttggggaccatgcagaaaaaggggcaaaagcagatcagaagtggactccctacacataccagtgagcagtcaaagagattctctgtttgtcacccaaaggcaagggtatccagctctggtgtctccctatggccatctgccattctcatatcctcgctctaaagtcaaccccaggaaactggttttctgttctccatcactgagtcaggccagggtgttatctagtggcctgtgctgaaaacccaaagtgggaagagaaactcagggcttgtacaagagtgccccttgtcccctgctcccctctgcccatagccaagcttggccctcacccgtgtggtctggcactgggtagagatgaggacatgtgcaaacgggtctgagaggccactgtcatctgctgccaacacaccgcgggcctggtacagatgagcccgcagctggaaatagctgaagtctgacatgaatggaaggaaggagccatgcttgctcaggagaccactggagctctcctactcatgaacccccacctagggcaaacagcaaggcggctgaccccctggccctatactcaccgtcccggtataggctgtgaggcagtccagccgagggttcaggcagaagatctgggggcagctcggaggtgcaggccttggcttgcttggccagccccagccacaggaagagctccagcttggcacagacctccccgggggctgccccaggtgcctgtgtgggaaggaggcatgttggccaccctaaagcatgccccaaatctctctgctaaatggaacccaagctcccagtacaggaggcatgccctctgttcccacttctgcgtctctctccatgccctccatcccgccccacacctcacatgaccctgcttcccatccccacagttttaactgcagattataatctggactctcccttgtcccttctagcctcaacacatttatactctatcctttgtgccaagggtcacagcttctcactgttaaaaacctgttttagtgtcttttccagacacaattcacctggaaaatctctgtctgtaatccaccagttctgcttgccagaatggtcaccctccttcctcattaccctgtctgtgtcaaagggccagcgctggcccagggcacacaagtttgctgttcagctgacctggacaaagctataacctccttttggctttttggatggttaaaaacagccagagaggttcctggttagaagccacagaccatcacccctgatgtcctgccctgtgctatgaaccccactctcaccagcgcctccaccccaggcccatctcactgtgagtagaagactctggatcttcccacagtctcggcctcgttcctcctccaccacagagaacagcacatcctgggcagggacgcgggcataggccacccggcgctggccgctgatcatccagaccagcacatcagggaagggtggctgcggctgcaagtggaggacaggtcacctggggagtctggagctaatgctacccgatcctaaagctgaatgggtaatttaaatgccccgacttttctgaacctctggtcctgtggccacctgctccctgacctctcctcctattgcaccatagggcacctcagactcgaagaccacctagaccacctagtctccacactgcattctgccccaatcactttttttttttttcagacagggtttctctgtgtagctctggagcctatcctggcactcgctctggagaccaggctggcctcgaactcacagagatccacctgcctctgcctcccaagtgatgggatgaaaggcgtgcgccaccaacgtccggagcccttgtcacttttaaatctacaattcaatggtgttaagtgcattcacaggtgtactgacagccatgcacccccagaaatcttctcattttacaaaacagaaactcaaaaaacaacaacaaaaacccagaaactcaacacccactgagcacagctccgcatttccagctgagggcccagttcccaataaccacaaagaaagcaaagtaatacaacacttaaaaagaaagctaggaatggagccgggcggatcccagggatctgacgccctcttcccacagacaccaggcacgaccgaggggcaaaaatatacacacaggccaagaatttatacacataaactaaataaaccttaaaaaaacaaaacaaaacaaaaacgacaacactagattgaatgagtatttgtgctatgaaatgtcatttgacaaaggaagactttcattacaaattttaaagacaggataggggtatgagtcagtggtaaaacatgcttatcatagggcaaagaagaaagggagagagggagggagagggagggagggaggggggagggagagaatggaaagaagattaatttcactctaagattccacttagtgaattcctctcctcttcctccttccagtgccattttccaccaggcctcccagttctgggcatttgcaagtgtcgctcctctcacacaccaaactgcaactatcaaatgtgcttgaaattcctgctgctgcttaaccagctatgccaagatagctagactgtcagcctccactggatgcctgttatggcacagacccctcccccaaggttgtttgaagaattacactagaactcaagcagatgcttcgtgcagaaagtgtcccaagcacaagctctcctcatacaccccagccacccacggtactaaacagaggaagccttgcccaaggcaagccagtcggctgtcctttccagcagctcttgagtcatctctggatccccgctgacccctcccttcctcactcttgacttccacatgaagcaggcggcacaatggcgccatccagaggacaactgttgcagatgccccaaggtctctagaatgatccagaacttaggtggggggaaatatgtagcgtaagaaagcatggtgggcaaggcatcacctccttagccaggaaatgcagctttgccaggagcttcttggccagtgccaccttcctttgcatgttgctctgcctcaggccccgtaaaagctgcaatccttgctttgccatcagattcttgggggcgggggagaggcagggagaacataagtagaaggactcagctaggtgccctccctcctcccagtccccagcctgtaccaggctgtgtgacagtagtttccctcgacatcgatccagggtgttgggtcgtgtcatcgtcctgcgctcagcaccaaggcaaaactgtctgcagagaagagagaagccacggtgagatcaggacctcagaaacacttccctcagaaggcctcctattcctgatcctgacagcccttcttcagagagcctcatgcccaaatgcaccaagcacaacctggtctttgagccctgcagtcaccaatatttaacatctcctgccctggctacttcagttatggcccaacagcctgactaacctctgcatgctatttagaaatgtcctgcctgtcctgtcagcaccacccaaggcctacagcaccaggcccttcgtgtttactttctgggagagtcctatacccatactaaatcaaagaagaatgcctgctttagtctccaccagcctaactaaaagatagctggacttccaggtgaaatggtagatgacacctttaatcccagcacgcaggaggcagaggcaggtggatctctgttagttctaggccaacctggtctattagagcgagttccaggacagccagggctaaactgtagggtaaaaagggccagtgaaagaaaacccaggccctaagacctaagccaaagaaacacaccctgcccctcaccaattcaataattgaaatccaaccaatccctgaacactaaaccaacaaatccctgagtatgaaatccaaccaatctctgatcttgttccaaactcaggaattaagatcctaccaatccccaccctgaaaatctctaccttggaaagccccacccttaagaaatcctgtataagctctgtactaactcagtttggggatgccctttttcttggcagaggcagcctctctcctggattcttccctcccaataaatctcttgagtgaggtttgttgtaacaacgttttctttccctggagcaaagcagagatgtacccgcccttgaagccagagccgagcagaactgttacatttctgtagtaaaatttccttagcagagcagagctgtaacaactttcattggggcagagcagagctgtaacaactttcactggggcagaacagagctttaacactgtggctggggaaactttcccttgctggaagaataattgttacactctggggaagctgagcagggctgtaacatttctctggagcagagtggaatagagctgtgacaacccaactggggaaatcctcctctgctaaagcagagttgttatactgacatgagggaaacatttcctggagcaaggattgtaacatttttctagggaaaccgccctccaccgcaacagagctgtaggtattccttggcttctgactgccaggatacctttcccttctgagcagtaacgcttacatcacagagaccttgtcttggggagggagaggaatccaatatcaggatggatatatgagtgagcaacagagcacacgcatagcatgtgtgatgctgagtttaatgtccagcaccacatgcatgtaacatgtatgtactggcaccctgcatctaaccacttctcccatcttcctctaggatcacccaggtgaaatgaccattgtgtctcacccaggatcactgcagtcacctcctcactgcactgtttgctgttctaaccctcatgccatagaacattctcaaaagcacccagaatgctgtcaacacgtttccatctattttgttctactcatctaaagctaaatcacaaaactctaaaaatggccaaaaggttctgcacatctggtccattatctccatcctcattaaatatgccttgtcccatgaaggacaactatgtgtcacactggcttctttgctcctccataaattatgtagagagcacgaagtctttgtgcacacagataagcaccaaggaatgtaggaaaagctaaatgcatagcttaactcttgagtggaatgaggtgcttagctgtagtttacagcctgatgaccctttgctgtctggtgagccaggctttgttcacatctcctagaatttgttttacttatcccagaccctccccctcaacaacagcaacaacaacaacataccttgagcattgcttctaagacataaaaccaccctcatgggtgatgtcacttgtatttttcaacagcctaagtgacttctatgccatcgtaggactaggccaatcctgacactcacaggcatgtttatctagtcagtcacagcctagatcctaaatcttggggcactatctctgagacaacagtacccatatttatgaaagaggccagatgtactttgtaaagagtctcaatacaaacctctctctctctctctttctgtgtgtgtgtgtgtgtgtgtgtgtgtgtgtgtgttcaagacagtttctctgtgtagccctggctgccctggaattagctctgaacagcagactaattttgaactttcagagatctcctgtttctacctcccaggtgctgggactaaaggcatatacataccaccactgcccagcttcgtgtcttaaatttgttatgcacttgggactgaattaattgttatcagaaaaccttttcacccaaaattatattgtgcttaaatatgactcaagtaaatgatctggtatcagcaccaatcatggattgtttccctgcctgctgtaagcctacagggacactccataaaattataccatacccattacccctcatagctacacagtgataccctatcttaaagggagggggcagcaaaaggagtgagcaagccacacagtagaaagctagggatgttatagaagtcaacaacagtaaggaatgagctctactgtgtctccaaaagatatgggtggagaagtgagcatccacaacccagggcttacagcttctggcgctgggatattctcattcttgttaagtactctatcacttaaaatgttattttttaattaaaaatatttttatttatttattaattttttcccctgagacaaggactcactatctctgtctgtcctggaactcattatgtagattggccttaaatacacagagatccacctgtctgtctctgccttcaaatgtagagattagtggcatgtgccaccgtgttcagcagccccctacttttaaaataaaaataatttttagggctttttgtgtttttttttttttttttgagacagggtttctctgtgtaacagctctggctatcctgtaacttgctttgtaaaccaggctggcattgaactcagagatctgcttgcctctgcctcccaagtgctgggattaaaggtatgcaccaccacttcccagcttagattgtataaatttatctgggaagacccaccagaactgtgggtggcaccatctcaagggctgaggttctgggttgaataaaatggagagggtgagctaagccccaagcactcctccctccctgcttcatggctgcagacacagtgtggtcagctgtgtgtcctgctcttgctgcaaagctttccctgctacaatggactgtaacccctaaaactgtaagccaacataaactcttccttaagtcattttggagagtgatctttcatagcaatgaggaaagtaacagatactgggtctgaaatcttgaagttcatctgtgactccacacatttttctccttttctacatttagccatactgaggtgacatctccaagtgtgaatccccagccccccccacccttttttgagacacgatctcttgtatgtcacactggtctcaagctgacgctgaccttgaacttctgatccccctgcctctacctcccaagtgctggggttataaatatgcaccgccacacctggtttctgcagtgctagggattgaaccagggctctgcaagcactcagtgctaggcaagcactctgccaagtcagttcatccacagctgtttaatccgtttacctcgtctccatcgcgtggttcagctctctgtcccctaaactactacaaagccttctttagtaaccctgtcttctctcacaccatctctctgccactcatcctttctaaagttataaagagaatttcaagaccctcagtggctctcccatcacccagaaaagaaaccatggtcattgcaatgacatggcaagtgtcacgagtgtttgctgaatagagagaaaacacttgagaaagtgtcagaaagggactcaagcgctagagcatgttatcaaattcatggcagtgaggtgaaagacagaaaccaccaggatgtgttcctgtgattagagcaacaactggtaactgggaaaggactagctaagggtgcagcagagacagatgatggcagagctagttatgcaggaggtgacgggagattgaatcagtatcccagacctgcaaccggggaagtagcttcctccctggatcaggaagaagggccaacaaatggatgtagaagctgaccaggtacaggctcgggggggggggcagggttgtcctttctcaggaaataggagagaagccttataagcctctagagccaaacaccccgtgatctatagcaagcaccattgatatggacacttcccattctctttcttctgtagatgctggacaaataatgcagcttgaaatcacccttgatttcaacagccgccatgactctcagctcacctgctcccagccaccagctcttccagagtctgcttgagccgtgtgcaggcacccaaccccgacctgcgctgaatcttctcaacctcctgcaggccctggtcctgtgtgggctccagcagaagtcagtcttgagggtctggggctcaccccaccccgccccacccattcatacccctggttctgcttctctagcccccttccggcttcactccgtctatcattgtacccatcccttcccaagctcccacaactttgttcccctcaggctgccacccatttcttggccctacaccaacaagacatgagctccaccccttagtgtctagtttggagcacctttccaaagctgagtcccttgtgtcctgtgtctgggcccttcccttcaggggtcaccttgctctcaccagcctctcagccactttgtacacactgttgctgctatgcaggcgccaagtataatcctcccagcggctccacacatgcaggcagggtttttggtgcagcagaggcaagcagaggtatggcctgggccagagagaagggagggggctgggggcatcccgagtgcttgaagacctatctataccctcctacaagtcacgcccgatcacttacccattgccatctacaggctcgggccactgatccggtgtccccagcaactcttcctcttcctgccctgcccctctgtcctcagatcccaggagaggccgagattcgctctctagtgtgctgccttcggctccctcatcagcccttgacctttggcccaattgctcctctcggcggcctgtgtgacctgcccccagaacatcaaggatcagagcctcaggctgagggtcctatgcatccctctgcagcctctcccccagtaggagcagagcccaccactctccctgaaggtgaacctccctccagtgcctaaagctgaaacaagaaggcaaacccatgaccttcagtgcttatttaggccacacaccaatggaaatctccaagctgataggctgcttggccagcgaaggatcaatcatggtagcctcaaagaccactgcaaaaagcaggaaatcttcgcagggtgccagggcattctaggaaagagagcaaggtcagctggggtcagctcccatcctccccaggagcagtttgctctatgcttggtcacaatgcccacagaaagatatcagctaaggtccagggggctctgtgagtgtcttacctccctcttggcccctggtagcttccctatacattggtccagaggacagattctctctggtccacgccctctatatataccatgtctgtgtacatcagaacacgtgtgcacatacactgaattctcaacccaagtccccaaattgataacagcatcatgatttctaaagcttggaaagggatttacaagccctagagccgagggtcaccaccaccagccccacctccggcagaggcagcaactcctccacctccacctccattgcgctaggaatctcaggtgcgtccccgctggcactggcatccacaggcttcggaacgccagccgtggtttgacgctgcttggttttcttctttttcttcccagtgagtcgggacaatctggacccctgtgtgctctggggggatgtaggttcaactctgccttccaacacctccatggacacagctaccagaattcggccccggaaccaaatgccttctccaacaccttcattgagactttgaagaccatcccggaacctgccactggggagcgagccatagaggggcacccaggctggaccaaaagtggggttaaaccccgctatgggggacaagaacagggtttggaggagagcacagggtaaatggagactgctctggactgtacacctttgtatcctccaggtgttggggggagggaaagagaaggctgagttctggaagggaacaggtctgtgacaaacagtagcagacagaggacctctctagacttcagaggggagctgagagtggggtagaagtactggtgtggtaattggcggagagggtgtggatactgaaaccactgacttcagagaggtcattttgcagcaaggcttgactggaacagtgggggtggggggtgggggtgggggtcatggttggaagacagagccttgtaggggacagtgtaagccacgcctgctagaagctggctacaggtgtgcctgaccatgcctgtcagggcgtggccaaggtgaggtcaggatgacacgtgatagggttttaagtggctgcaaggcacatgggagccccttctctctggcctccctgccttgctgcccctggcacgctctggcttgcgtttggctggtgtttctctaaataaagatatcttagccttacagacaccagatcatctcaatagagcctggcttagaacagttcgttttgtggggtggatggtcctcccttgatcacctgtgttttaaggatgttttgttcnnnnnnnnnnnnnnnnnnnnnnnnnnnnnnnnnnnnnnnnnnnnnnnnnttacactcacctgtgcgaccggagttcgaaatctgcctcaggtccagcacatgtgtggcgagtgccacatccaggagcggtgcatcttcacgcagctgcaggcgaaggccacgtgttagcggtgggaagagttccacaaagctcaactgctcgttccactcgggctccgtctcctcttcacacacagaagtctcaccctgaaggccaagtcaggaggagggagttagtgtgggtcccaaaggatagttctgcaggttatagtgcttgatatcaagtgcgatgacctgagtttgatccccagatcctatactgctgtccctcctgcagggtgtcctctgacctccacacatgtgccatggcactcagggcacccacacacatacacaaaataaataataaaggctggagggctggagagatggctcagaggttaagagcactgactgctcttccagaggtcctgagttcaattcccagcaaccacatggtggcttacaaccatctgttatgagatctggtgccctcttctggtgtgcagatatatatggaagcagaatgttgtatacataataaataaataaaaataaaaaaataataaaggctggagagagcgctctgggattaaagttagagcaagtactcttccagggagtgagtttgcttcccagtccacacagggtgcatcacaccaccaccctgactccagctgcagggggtctgactccctcttcaggcctccatgggcacttgtactcatgtgcacagaataccacagatattccacatacacacaattaagaataatagcagccaggcattgtgacacatgcctaatcctaccaagggaatctgagttccaggcctggtagggctacatagcaaaaccttatcccaaaataagatatctttaataaataaataaaattttaaaaggttcgagctgtggcatagggggataagcgtgacttacctgctgccccaggaagctcaccctcacatagggatccaggaggacgtgttggtcatgcaaggcacgggccagactgcctagcagccccgtgcgcactgtaggaagaccctctgcacggtacacacgtacacgcaggcgtgcccacggtctctcagcctgcaccccacgtggcaggagtagattcctaggaacatccctcactgaggagtaaagctagagcctgagcccctctgcttctctgacccccccccccaggccatgcctcctccaatcctccactcccgtgtcactcccgggtcactccagctcacttctcgatgtctgaactggtcccagggattggagcgggcagtggaaggggaagatccccgcgtgccctcacagacaaggtgatcttgacaaagcccttggtcccagatcgggtgtcacagggatcatgtaggggagcccacttttggtggaaatgcccatctaaggatggaaaggagtgagaggtgcctaaggaatacaccgagttgtttcaggacattggacagtggctggggttctgggcaaagcattctatctggcatagagagaagagcctaagcacaagaaaggtcagccatcacaagagatgaccttctcagaagttagtgcactggggacagcacaggtgagtgaccagagctcagtttctggagtctttgttcatgtaaatgagtttcaatgagagaggggggttcaatacctggctggtccaaggccatgcccagatccatcctgaaggtgcctaccctggtggccatgaatgggagagtctgcgagtggaaaacctggggagagaagggttagtcctggtgctttggtacctttctccctgcccccttgtaagtctctctatagccctggcagggctttgaactcatggcactcttgctgcctcagccacccaaagactcagctgggcatcgcccctttctcaaaataatcctctttctcactcacagtgatctctatcagcaactcttggaggtgaagccgagtcttgtgaaattcgaacaagaagtactgggttgagtgagatgagaaagggaaagagcgttaggtgtgaaagatgcattcagcttgccccgcaatctcttcactcataaaaccagaattgttgcacccaggcctgccctctccagggacagggtgtctctgatcacccccattctctcaagcccaccctattccttggtggtgctcacctcattgtagaaggggcaattggttccacgctgtgttgcagtcacacgacgctgatcccccacacgaacagccacatagggattaatattgacgcccaccagtttctgggcctcaagaatggtgacccccacctaggtaaggaatgcaaaagagggaggaaagagagtgagacctgcctggatgaggggagaaacctgtgagattccatgaggattagagcatggcccaagagtcatacctggaagtcctgggctctgcacacctggaagggatccctacggggcaggcccagggtgcggctgtagagaagcatagggtcaacttcacgtccccttcctcagccgcccacacatacagttgcctggcgctgggataaggactccgcaccatgaacttttggagtttaagtcctttcagattgcattgccctaccttcatctcaggcctacatccagaatttgactcattcttggagcgccaaaaccatttgtttgctcagcaaaggttgattgagacctgctatgtgccagcactgttctaagagctgtaacactgacatgaacaatagacaaaacctaccctaatcaagtctctttattaactagtgtgagccactacaactgagtttgaacacgatggtgtctgtgcctataagtgaatgactcttgatgccagacaatccacctctcccctacaccctggtgtggatgggtgtggccttatgtatgaggaagactgactcagtgacagggtgtgagagcaggtgtatgggaacacgttaccttttgagggggctgaacaccaccccagaaatctccacgtcaggctcgtcctccagctccagctccagctccagctcgttctcttcatcatcctgtgtccctaggcttcgagctagcctgcggcccagagccactgcctgacgctccagccgggcctccccaggcctaatggaaaagaccctcagagatcatctgttgctgggcatcccttgtttttgcttattttatgattgacctttgatttcagattgatcccgctattctgggactaattctttttttgttttgttttgttttgttttttaagtcaggtaatagccctggctgtcctagaactccctttgaaggccaggctggccttgaactcacagatctgcctgcctttgccttccaagtgctgggaataaaggcgtgtgccaccacacctggctttggactcttaatcctgagaccattctaacttcagaaccttgtcctgctgcaaggattgacctctgaccttataattcattcatcccattctcagactctgggactaactccatgtcactggttctcaacctcaaaactgaccccgtggctctcaatcactccctcatacttactccatctcctggaagcccacattggggatgatcagctctgagctgggagggaaaatagagaggtaagacccgctgagaatgcactcagagtcacagcacccagcacacccagtaaggagacgaatgctccctttctctctttgggctgagtttcatctgcggacaccagaccttgcttaggattattacctgtctcgaatgggtgtcccaaagtcctcctctacccaggttccagcagctccctcagggggctgatactttaagtcaagctccacctggatctgaaacaagatacgatgcccataggtccctcaaaccgacatggggctaggagagtgtgacggggaatgttcttctgtgcagacgtttcttttattggttaatgaataaaaccatgatttgccaaggcaggatgataggtaggattgggagacaaggaggattctgggaagtataggcagagaggagttgttatgtgatcccggaagtgacatggctgggcagaaactgcacatcagccgggacaaataggaaatcgttctcttctctgctgaaatgctgaacagtcgagatgtaggtcgccagaggagtaagaggtccctggacctttctctggtcaaataagaccacgtggagatacttagatttttagaaatgggttaatgattaagaataagaaaacttagccaaaggccaacagctttataactatatagtgtctgtgtgcttttggggggacagagaagggcagtgggaccaaatgggccaagaatctgacattacaagagtatctggacaatgcattacacttcgtctgcaaatagagaccctttggactgtgtatgtagtaacatgttcctctctcattatcaatgttagcactcacaatcctctgcatttgctagctgccagaagaggtaaagtcagctgtctttaatgacgtgacccctggggggtaaactacactccaaggcaggccccacttccaagagcagtcaggcaacataaactgaactattgtcagggggtggaaaagaaaaaagaaaactcacagttgggtgggaagggaggtgagggtggaaagaagacacatgggaagagttgggaatgaatatgatcaaaatatattctattaagttcttatggaattaacaaagaatattatttttaaaatagtcacagccttcttgagaactacaggcaatgatctggggagacggcctagtaggttaaagatgcttgttggcaatcctgacaacctgagtttgatgcccagaacctacacagtggaggaagagaaccgactcctagaaggtgtctaacttctggacatatgcctactcacacataagaaaataaatgtttggctgggcaatggtggcgcacacctttaatcccagcactcaggaggcagaggcaggcggatctctgagttcagaggccagcctggtctacagagtgagttctaggacagccagggatgcacagagaaaccctgtcttgaaaaaacaaaataatgaactaaaataaatacatgtttaaggggctagagagatgactcatctgttaagagcactggctgctcttccagaggacttgggttcaatacccagtacccacatagtgactcataagcatctataatgggatctgattccctcttctggcatgcaggtgtacatgcagacgcccagcactagggaggcagaggcaggcagatctctgtgagttcgagactagcctggtctacaggagctagttccaggacagcctccaaaagccacagggaaaccctgtctcgaaaaagaaaattatttatttattatgtatacagtcttctgcctgcatgccagcagagggtaccagatctcattcaaggtggttgtgagccaccatgtagttgctgggaattgaactcaggacctctgtaggaagagtcagtgctcttaaccgttgagccatctctccagcccttaaaattatttttgagacagggttttagtgtagcctggaagtcactaaaccaagccagcctggaacacagagagatccacctgcctctgccaggattaaaggtgtgtacccccgtgctccgctataaataaaaaggaaatcaatgaaaagaacttaaggctggagatccagcccagttggtacagtgcttgtctagcattcagaaaggcttgggtttgggttcagcagtactgaaaacaaacaaatctaagcttggaaaacacaaaacaaacagcaacaaaactcagcttcaatgtgcaagttgcctcttgagctgattccttctctggtccctgacaacttctccagctccatctcattataggtttctgtcctgctcagcaccccaacaatgctccatcagcaccctgggatttcacttattcaggatcctctatctcaacattctccttcctacctagctaacacctataaccttccattctgagctcaagcaccatttccccaggggaactcttctgacttcctcatctaggtcagactggttatccacgctcatagactcttaccagccctgcagcattcaccagcagcaagactacctctacctgtgtggatgcttgcttagtgttgggcccccttggttcagctagtgagcttcaataaagcaaatctttatttggttttgcttatcactgaatccctattgctcaatatcatccttgaacttaaccaatgattgaatggaaaaaaaaaaaaaaaagtctgattctccattacgtaaatggggaaacagcttggagatgctgaactctactaggttctccagggggaacggagatttgaagccaggtccacctcttttaaaggtgtgcaaccttccaggaaaatcctaccaggttcatcattgtcacctgtaagaaaagaagtgagcctaccccagatccaaggagcaatggtacactcaccacacccccttgtgactcagaaatagcctgattctggcctgtgtaggactcaggcaggggctgtaagaaagggagcctaagttggggccgggtgcttgttgccactcctgtctggctcaacttttcccctcagttaaatggaaccatctgtttggaggaagtctcagacttgctgacagttggctggtggcacttaccggggacactcggagtttctcatccactagggcttccctcagcaccaagtgcccagaactctgtaactgctgcagggaaatcaccagggtccccagggacctagaagaaaggcatagagcagaagagtggggcaggtagttgacactaagccacttcctggcttcctccagttctactcacctggggctgaacacacggctacagttgaccacctgtacagtcagactctctccagccagtggagatccatagtggggccaacgaaacatctgaggagacaggaagacgctcgtaactggatgctaggctgaccctcacagagtctattcccaactgttcaaatgtgaggccacacctaagagtaatctcctaagcccagaacaaacccctccaacatggggttgacttcagtctagggctcatctgggactccttgccaatcaagcactaatcccactagttttgagactggggtcttaaaccagggctaacgtctcaaacctgagacgcacaccatttctggagaccataccttccaggcccaggaatgagcccttctgccccagcatggaccccaaaaggaaaatactgacttcttttcagctgggaaccagctatactgacctcaccaacatctgcttctcggccacaatgaattttccttgttttctgggtaaagcctgctcaaaaatgaagcttttatcaggccctccacacacacaaatcatttacctccccaacccatgacccactgccgacttccccactcaaacttaaaggtgggagataaggaaacaagtagaagccagggagaagggagacgggttatagagctggcaaggatttaagttggagggaatgaagaatccagaaacccccagctctaaaagtccccatccatgcaaatctcaccacggaagcagagcttcacttgtcggtcatggatgcctggcagctctgttaggcgtctcacacacacggtcagagccatggcgcagtgctgtggctcagtctgcctgcttgcccttctgcccaccagtgttgtccatgactcactggactcacccagcaggttcagcaatcccttccctctagtcaaacacacagggagcaggcctggaggtcatgggtgggaaggcctgaggcctgagaggtggggtcagcccagagctcttcccataccgtcggcaggatggcaagaagggcaagaagcttcagcctgtatctcatctttgtgggatgggagctgggatcgggtacagatagagaacatctcaggctggtccttgctagcccgtgaggcctcaagccttcatgttctttctatcgctgtggtagaacaccatgaccaaaagcaagtcttggaaagggcttatttcactcacgcttgcatatcaaacagctggaactcaagcatgcagaggctatggagaagttccgcttactggcttgctcatcatggcttactcagtctgccttttagtttgtttgctttctaatagaatcgaggactgccagcccagaaatgtccccatccacaataagctgggccctccaccatcaataagttaagaaaatgcccaacaggcttgcctaaagcccgctctgacagacattttctcaattgaggtttcttcctctcagatgactttagcttgtgtcaagttgacataaaactagccagaacaattgaccctttgtccacttgacacaccaataaaacactatttaacaataacctttccatttttgttcattcacaatctctcatattaataaataaaacaatataaaacatactgagctgggcagtggtggtgaatgcctgtaatcccagcactcgggaggtagaggcaggtggctctctgtgagtttgaggccaacctggtctacaaagctacacagagaaaccctgccccccccaaaaaaaagaacattggaaacttagaattctcacaggtttttatttattgggggcagggatttttgagacagggtttctctgtgtagctctggttgtcgtggaactcactctgtagaccaacttggcctcaaactgggagatctgcctgcctctgcctcccaagggctgggattaaaggctatgctaccactgcctggctaaaagcctcacaagctcacagtctttacaaactcaaacactttaaaaatgcaggcttttagaatacaagattaactcaaaaaaatcagtagccctcctatatacaaatgataaacagagtgagaaagaaatcagagaaacatcaccctttacaatagccacaaataacaaaatattttggggtaactctagtcaaacaagtgaaagacctatttgacaagaacttcaagcctttaaagaaagaaattaaagaagatatcagaaaatggaaagatcttccatgctcttggataggtaggatcaacatagtcaaaaatggcaatcttgccaaaagcaatcaacagattcaatgcaatccccatcaaaatcccagcacaatttttcacagacctggaaagaataatacttaacttcatatggaaaaacaaaaaaaccaggatagccaaaataatcctgtacaataaaggataatctggggacatcaccatccctgacttcaagctgtattatagagcaatggtaatgaaaatagcttggtataggcataaaaacagacaggtggaccaatgtccaaagaccccgatatcaatccacacacctataaacacctaatttttgacaaagacgctaaaaatacaaaatggaaaaaagaaaacatattttacaaatgatcctggtataactggctgtcaacatgtagaagaatgcaaatagatccatatctatcactaggcacaaaacaagtccaaatggacccaagacctcaatataaatccatccacactgaacctcatagaagagaaagttgtgacgtctgtgccaggacaaagtccgagtattgggggaaagactggagatttatttaaaagccgaaatgtccggtcgcttgtgctatgtgcatctatccaactttattcatctcctttattccagggagagagcagccttatatacacttacagcacagttgaaatgcctcagatgtaagagcacgtggaggaagagctcgtgttttcctaggtgtagtggggtgaggccggggctgtaagccaggactagaacacaggatgcacctgtgattattggctgacaagcaactagagaccccgtgggggctgggacccaaaagaaagtgggaaatacacttgaaagcataggtacaggagatcacttcctaaatagaacaccagtagcacagacactgagagcaacaattaataaatggaaccccctgaaactgagaagcttctgtaaagcaaagaacgcagtcaacaagacaaaatggctccttacagaatgggaagagatcttcaccaaccccatatctgacagaaggctgatctccaaaatatacaaagaactcaagaaactagaaattgaactaccaaataatccaattaaaaatggggtccgtgttgggtgttgatggtgcatgcctttaatcccagcactcaggaggcagaggcagaaggatctctgtttgaggccagcctggactatagagcgagtaccaggataggctctccaaagctacactgagaaaccctgtcttggaaagaaatggggtacagataaacagaattctcaacagaacaatctcaaatggcagaaagacacttaaggaattgctcagcatccttagtcatcagggaaatgcaaatcaacaccactctgagattccatcttacactgatcagaatggctaagatcaaaaacacaatgacagcttaagctggagaggatgtggagaaaggagaacactcctccattgctggtgggagcgccaacttgtacagccactgtggaaatcagtatggtgatttctcagaaaattagggatcaacttacctcaaaaccctgcaataccactgttgggcatatacccaagggaggcacaaggacatttgctcaactatgttcataacaacattatttgtaatagcaagatcttggaaacaacctagatgtccagcctagacacaggggtatgggggtggagaggtgccttggtgctgcctcaatgagaagatgggacagacttagtagacttcctagtggaggccgtaccctctccaaggaacagatgggaggaaggggagaggggtgagcaggaggagaggaaggaggggaaaatgggattggaatgtaaaaattaaattaataaaaaaattagtcttaccaggccatgctggcacacacctttaaacctaacacttgggaagcagaagcaggtggatctctgtgagttcaaggccagcctggtcgacagagtcagttccagggcagccaaggctacacagagaaaccctgactcaaaaaacaaaaacaaaacaaaacaaacaaaaagacagtctctaaaaatctagcctctataaaacttcaaaatctctttaaaagttcacagtctctcaactgtgggctcctgtaaaataaattacaaacttcctcattccaagaaggtagaaccagggcacagtcacaatctgaaaaagcaaaatcagacttctgggactcactcacaatgttccgggtttcttctaatggtctgccacagaacacatagcttgtcttgtaggctcaggccagctctactacatacataactgctgctgtccttggtgactatcctatggactggcatctccagaatgctggagtttcttgctgcaagtaggttgcactttcaccaatagcctctcttaggccctcttcctgggaccgagcagaatttctcttcatgaccccttcagtcctggccttcaactgtccctttgtctgtaccttcaccgatgacctttcctggcctctcacagtgcccaagcctcagctgctcgctctccatggccccttcaagccttcaaaatcactacctgagagattcttacaagtaaccaagttcagctgccagcataaagtataacctaggcccctcctcaaacccttgcactgacctgaaacactttccagaagatttcccctctgagctgggcttttctcactaatctctcagttccagctgacctgcatcaattgtcagaggaaagcaatgttttcaccttagaggctttggtgtcttgttaatcagtcaattcttcagtaccagctgaccagacaccacagagtcttaattcaaaatatgcaatggctccaatagagtctttaagtgactctcaaacttccctctggaacttcataagccacgtctccatcatctgtatttctctcaaaatcttatcttccaagctcctacagaactgctcacccagctctgaacacccaatggcttttctagccccgtgtgccaaagttattccacaggcctccaaaaaagcatatgatcaggtctgtcacagaaaatccccagtgcctagtactgatttctttcttagttaggcttaactactgctgtaatgaaacaccttgaccaaaagcaacttgggaggaaagggtttatttggctttcatatcccgagtcacacagtccattgagggaaactaaggcaggaactcaagcaaggcaggaacttggaggcaggagctgatgcagagaccatggagaagggctgcttactgtcttgctcctcctgcctttttattttgttttattttaatagaatctaagactaccagcccaggggtgtcctcacccacaatgggctggtccccgctccatcagtcactaattaagaagacactctacaggtctgcctacagccagatcttatgtaggcaattctcagttaaggttatgagactgtgagaatatgacccttccaaatcaacctttaatcaagcagatacccacaggcttgcttacaggccaatctgattgggacattttctcaattgaggttccctcttctgagatggccctaatttgtgtcaggttgacataaatgaataaaaaatgtgtggcctctgtgtaagcctggctgtcctggaactcactatgtagatcaggctagccttgaactcagaactcctcctgttttaattttcaaaatgccatgaagagaagccattccatgcaacaggactcacatggcaggtttattagaagaggagagagaaggggcagaaaggggcagagagaggggcagagactggtccctggggacaagagtggagcgagagaaagggagagagggtgggagggcgagaaagatgggggtgaggggaagggaggagggaggggagttagaggggggggaggagtgagatgggcaggaccctttttaaaagagagcatagtgaattgcacaggtggtgctcttagtggctgcagctgagggtgtatcctgtcagatacctgaatactagcattcctcccttttattataaagaggtcaggcattaggaaggggtagcaggtgaggaaggaatgatgatgatgccatgttctcaagactacttcccgctgacctaaggggcattgtttatctttggggtacctgggaacactggggtgctgaccacgtgctggagcagctgcccatttcacttcactgtccaggctctgtggaactaccaggcatggcctggacctggcagaatgctgttcaaggtggatccaagtagactccctagggcctaaagcacctgacactttcctcccacaatgtcactggacgtgtttggtcatcttgcaccaccagccctgtggccaatagtcctgaaacaatagctgattaagaatgtccagtggcaggtgttggtggcacatgcctttaatctcagcactcaggaggcagaggcaggcggatctctttgagttcgaggccagcctggtctccagagcgagtgccaggatagataggctccaaagcttcacagagaaaccctgtctcaaaaaacaaaaaaacaaacaaacaaaaatgaaccccctctccccagtgttagtgctgcaagcactcaccacattgttgaattgatgagtggttgaatgtatccctagactacatagagtagttggactttgtgcctcttaaccagaagccataggtccttagcttaatgtactagaacttgagtgaagctgtaaatggagtctgggagtctgcaaaccttagaatcagactaaaaattaactatgtgtgcatttgtatataaatgccctacttagttgttaacatttactttcactactattttttaaagattttatttatttatatgtttacagtgttctggcatgtatacctacacactaggagaagacaccaaatctcatgacagatggttgtgagctaccatgtggttgctgggaattgaactcaggactctggaagagcagccagtgagcttaacctctgagccatccctccagccctacttttactattattgatgtgtacctgtgtgcatttgtgttcagatccctgggagctggagttgcaggcaattgtaaattgtctgatgtgaatcctgagaaccaaactctggtcctctggatgagcagcactcctcgctcctgagctatctctccagcctccgattagttttgaatttctaaattacatttgtttgcatattatttattttggagggtgtgtgtacatgttacagcatgcttgtggaggtcagacgacaacttgcaggagtgagttctcttcttccaccctgtggatcctgggagtcaaatttaagcctgcgttggtcagacttggcagcacattttactagcttatccatctccctggcccaattattcctttttttgtttgtgtttttttataactttttgtattagaatgaaaattattttacatgtcaatcccaggtgtgttttgttttttgagacagggtttctctgtgtagtcctgcctgtccttgtactagctctgtagaccaggctaaccttgaactcagagatctgcctgcctctgtctcccgagttctgggattagagatgtacaccaccactgtctcaactcccaattactccttttttttgggggggggtcttcgagacagggtttctctgtagctttggagcctatctatcctggcactcactctggagaccaggctggcctcgaactcacagagatccccctgcttctgtctcccgagtgctgggattaaaggcgtgcgccaccaacgcccggcccaattactcctttttaatttacttcctatgtgcagaacttttgcagtgttctcacaaatggagagatagagccaagcagtggtgaaacagatgtgttctttatctctcagaagtttcatacgtgccaataataacacagcataaaaaagagtataccgcagttactttcacagtaggaaaaagtcaggaatggggatctctgaggagggagggcagagggatctgtgtagtggcatcttgttctgccaatggacttggggtggcggccacatcttaaggtgtgactttactgtgtacagacgtgacccctcctaaggaagaggagaggatggctctttctcctgggttgtggtgggagcaccctgaagggcagaggctgcatcttcaggagcaggaagggtcacgcagttattcaccatcattgtgtgagtgttccccaaataaatacctattatttctttatctgggtatttgtggactccttcaaacagccttcagatctgaagataaaaactgggaccaaagaccagcattcaggcagtgggaaggaatagtgtgtcccaagactagtaacttgttcagcttggctgaaatacaaggaatgcacacagcaataacagataaggttggactatcagcagaactgggtcttgttataaaacttcaagctaagtatctggctcctccctgtgtcagcttttccatctcaatagcagcatgagggagaactggagatatgctcagtttgtagaatacctgcttggcatgcaggaggccataggtttattcccagcatagtgaataactataaccccagaatttaggagagggaggcaggaggatgagaggttcaaggtcatcattacacagtgagtttgagtcaaatgtgggcaaccggaaagagatcctcttctaaaacctcaaagtcacgcaaaacaaaataacaagaacaaaactccgtatttgacaagaaaggttgctttttaagttaatgtttttgagaatttcatatgtggtatgattcccaacacccttcctactccaaatcctcccatgccccatcactccctctcaaactcatgatctcttctataattatcattgcatgtggacacacacacacacacacacacacacacacacacacacaccctacagagcccgtttagtgttgcacttacacacatgtgctcagggctgaccccttgggataacctgtcagtatgtttgtctctagagaaaactgatgctcctcctctcagcagccacagtttgccagtagctcatcaagaggtggggcctcatgcaagtcccctcatccctgttggcgtgccttgtgttattatgcagaccttgttcatgaatgaagcatctctggctttaacaatcttcctgctccttcttccaatgtttcctaagccttaggtgttaagggttgcattgtagacgtttgggggtcctccctttgtattgttggccaaggtggtccaaggttgctctctttttaagatccagattagctgtcacagtacttagatgctaaggaggggctttaccgccctctgtcagagaaactgaaacccaaaggagttctcaaactgagtacagggcagggtcagaatgggactgcctggctgagatcagatttctattcctctttcctcctgggctctgtggaatctaaagtcacattaatgtcacctctctagagcctggaacaagtacctcctttgggcgggaatacagcttaccataacagactgtctctgttcctcagcctctctacgaactgccacttctgcaagctggctaacattctaagtaagatgcgatgtgtccaaaacaaacaaaaacaaacaaacaaacaaacaaagcattgggctggggtgcatgcaggattttggaattgtttttggtgtgtttttgttttgttttgtttgttcttgagacggtatctctgtatatagacctggctctcctgagactccttatgtagaccaggttgcctttgaactcagaagtcagagattctcctgcttctacctccatagtgctaagattaaaatcctgttctaccaccatgctgggtcaggatttccagatgtcatgcaacatgatctcagggaagtaagccctcttccctctctgcacctgttggactccttgtataaatcttgtgagttgcactccattgcttttcctggtgtggaccttaattaggatagagcatatagttaaaatgtacattctaggacaggaagatggctcagtggcacttgctgccaagcctgaaaacttgaatttgattcctgattcccacatggtggaaagagaaaactaattcccaccagttgtcctctgatctacacatacacagagagagagcagtaagggggagaggaaataaagaggagagagagagagagacagagagagagagacagagacagagacagagacagagacagagacagagggctggaagtgtagtcatgtagtcatgcctttaccccagtgttgggaggtagaggccggcagatctgagcaccagaccaactttggctgcatagtgagactgtttcaaaaataaagagggtgattgaaacaaagtaatttttttaattggttgaattgttccttcttaatatttactaagtattggtaaatacctgggtactcattataggctagacctatctaggtgctggaggatacagaaatgaacaaaacaagcaaaatccccattcttgccagccattggtggcacacgcttttaatcccagaactctggaggctgaggcaggtggaaccgtgagtactagtctacagatcaagttcaaggatggccagtgttacacagagaaactttgtctccacacgcccccacccccgcccaagcctcataagttaacattgggtatgacaggcataatgaaacgtctgtaattcaatcacatgggcgactcagtcagtattactctgacttgggatcatcttgggctacatagccagtacccgggcagcaagacttcatgtccaaaatacataaaggacttggaagatggcagtcaatgaagacccaagtggacccaagtgcagactccactctagtgaaaagctaggccaggggcctgtaatcccaactctggggaggtggacacggcagaatcccaggacttgctggtttgctcagaaaacaaagtgaagggctgacatagcccagtgaataaactgcttgctgcccgagcatgaggacctcagttgctagccccagaatcgacatgaataaagggtgcaatggcacatgcctgtaatcaaaagctctgggggagcagccaggggggactgaagagatggctcagaggttaagagcaccgactgctcttccagaggtcctgagttcaattcccaaaaaaaaaaaaaaaaaaaaaaaaaagaaccatggggtcttgcaggcactagcttacaaacaaacaaaaaacaaaaaccggtgagccccaggttcagtctctcaaaagctaaggtggagagcgacggaagacagcaaacatcaacctctggacacacactttgcacatacacgcacacacacgcgcacacgcacacacacgcgcgcacacgcacacagcggtggtaaataggtgtccgctaggctcccgtgacgtcaggcggttctgtgacacggctcctctgtgacgccaacagcgggcaggtcgcagacgccagggctgagtcggccgcgccgcccggggttcacgcagggtccgaccccgcggcgcgcggcagctgagggagggccgagggctttggctgctgcggcgacttcggcttcccggggtgggggcagccccaggtcaggatgcggcggagccaccgcccaggctcggccgcatcctctcacaatcacgcacccgacttctacagcgagaacagcaatagttcccacagcgtgacttcgggggacagcaatgggcgccggtcccctgggccggagctcgagcagcccgagggcagaagggcccggggctcgagctgtggtgagcccgccttaagtccaggagtgcccggaggagacacacgggcaggaagctctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccggggcttgttcttccgcggaccgaggctctcccgccccgcatctgggggtgcgcagggagcgcggcataggcgcgcggcgggaccacggcctgcccagcggtttagcactaggctcaggagcctgcgcccgggccccgggggaaatgcgggtccgtggtgcacagcacctcaatggagccctgggctcccacagaaccgtgtggatcttccgcagtcttggaggagcagctcaaccttatcccgagcctggatctgaggcaggagatgcctccggtgcgggtgtccaagagcttcctgagtacgagccagaccagccccctcccctctgactggcactcggaaccccagtcagttctcctgcccgagactgggtcccagagtccagcccgatcccctctgaccttggcactcggaagcccagttctccttccccggcccgggtccgagtgtccggcctcagctcgttttcccagcccaccctcgcctcctgagcccccggacctcaccccgcggccctcccgagcctccctgaacctgcaccacccctccctcatagcgcgtcctctctgaacggcttctcctgtccccgtcccagacctcctctttcaggtgctgagcgtattgttatcggtggcaggagacgcgctggtcagtgtgtacaggtcagagcaaggaggagcagggatggctcagggaagggcagcagggctgggccccaccaaggcttgagcttattcgtgtctggttgagtcgagttcccgggaactgggtctaggatcctggggtcgaggcgagggtgggttagggcctcagagcatcagcttctgtcacggtttctcagggaggtctgctccatccgcttcctgttaactgctgtgacgctcctgagcgtctttctggcaggtgaggagcttcgattccctggggtcccagctctgcaggtttgcagccaaatccagctcgcatgtccctgtgcccctcagctcactctagtgacccctgcttggtctctcacagtccttgtgcagccccagccaccatcccaacccctttgctttcctccgtgtccctttataccagagaatgccccttctctttctccagcactctggtggggtctcctgtatctggtccccgctttagagaatgtgagttggggagactatgtccccaggtggggtggaggttgtgtgggtgggtggggcatcactgggctgctgggagtgggcagtataggaagctttgggtataatatccagaggccaacggagaatgggagggaaatgggagtagttctcaagagggaggccgcgtgagtctagccacgccttgcagacttgggagaagcttgcttatttgtccctccttatttgtcccttcaacaggaacctaaggagatgctgactctaaggtgaaagggcagctggggtgggatgtgggcagctctgaaatctatctatgggggccagggacaggtagctaaccacatggtgcctaccgcctccccccccacgccttgtagccaataccaccagcgtgtgtactcccagggccagcagctgcagcagctccagacagaactgaataaactccacaaggaggtgtccagcgttcgtgcagctcacagtgaggtgtgtccctgcgttggtttggggggtgggtgtaggtattcgctctgcgttcactcaaggctgcactttggaactaccacagcctgggttctgagacgaatcttcgctccagatacccacagtggggactctttttctaggcccttaaggtcctatctctgagtattgagttactgagaggcaggcccactgtaaactagcctgcaaccctcctgtcccaccctctgagtctttagagagtggccaagctcgtgttccagaggctgaatgaggactttgtgcggaaacccgactatgcactgagctctgtgggtaagacacaaatatgtggaaggaacttggactccaggtcatagacaactgtgttaatgcgaaagtgacttctgcctgttctaggagcctccatcgacctggagaagacatccagtgactatgaggataccaacactgtctatttctggaaccgcctgagcttctggaactatgcacgcccaccctcagtcatcctggaggtgggcctggaaccagggtgctggggatgggaccaaagggcaagagccagggtaagagcaagaatcaacttggtagaggcaggactggagttgaggtcagtttggcatcaggaggtgccccactggaggcagggtctggcatggtgtgggaaggctcctgccaagccaaggatgaagttaaactgaagagaattgtaaactctggggacttagcattgcctcacacgactaggcaagaaccaagggaacaggcaaagctctgggctgagaagctctagggcaaggtcttgctatccagctcaggctgctctccaattctcagtactgtctggtctccagttcgttatatgttctgatggtctgcccaaacccctgcagccagatgtgttccctggaaactgctgggcttttgaaggtgatcaaggccaggtggtgatccgactgccaggtcatgtgcagttaagcgacgtcaccctgcagcatcctccacccactgtggcacacactggaggagccagcagtgcaccccgggactttgcagtctttgtaagtggggccgaggccaggaggtggggaagttttagaaacccctaggtagtggtgagaagcattgccggcatttgtcattgtttgttcatctataagctggacatactcacaggctgctgcaggttgtaagtttagcatccctggtactaggatgtcctggctgttactggtttcttcaagcctacattccacaatgcaccacctacattagaatgtgaacaggacccatgtagctgttgaacatgtatgtagaaggcctgagcaaagcagtttcccctcccttcctgtgtctcacggggctcctccatatactcttcacccaccaggggctccaggctgatgatgagactgaagtgttcttgggaaaattcatctttgatgtgcagaaatctgaaattcagactttccatctacaggtgtgtttatctctgggggtgctaacatgggggcagtgaacactgatggggaggacagtcttgagagcagttgttggcatgatccatttgtttccccagaatgaccctccatcagccttccctaaggtgaaaattcagattctaagcaactggggccatccacgtttcacatgcttatatcgagtccgtgcccatggtgtgaggatctcagagtgggcagaggacaatgccacaggggtcgctgggggaccccattaaaaatgctgatggttgaagcagaattgagatttgtgctaaagaaaactgcttcagagttgggaggtcaccttttggggaaagctctgcctatggcaggtcagtatggcagaatatgcccctcaacacatcctcttttcctggaaaagtccagagtcatatagtagcaaaagttgatgtttccagtgtctaccatatgcaagagacagtgttgtggacattctacaccgtacaagatgcagcttgatcctcaatacaaagaaggaaactgctagtgcaacttgctccactcacgctagtgaagagttacacaagaatggggccttcctcaagaggcatccttccctcttcagctggagaactatcatgtcgctaaagccacacgtcaactcaaatctctaccccaataacggggaaactctcctctggcaaacagtgaaaagctaagttctgaaaacttctaggaaatctttgagtcaaagctgacctaggcttggtagccctcatgcagttggtcattcctaggaccttaggtggtcatctgacgtccatctgatctaagtcttcgctggaatggtgaaaagaactaggggtggaaagtacaaacaggcagtcaagtaagtcgagttcctagggtgggaaagggcctcacatgagcaaagacaagcactatttatcttggatgttgggatccttcctactgatatgtgaagcagatcacttattattcacctatttaaattagggtgatagtattttgtcatttgaaaaaagcacttacaccaagtattttcaaaacctaagatttcggggctggagagatggctcattgttaatactggctgcccttccagaggacccgagtttgattcccagcaaccacctataactccagttctagggaatctaatgccctcttccagccttctcaggcactaggcacacatgtggtatattcaagcaggcagaacacccaaacacatgaaaattcaacaaaaggtaaggttaggacaggtgggatgtctcaacagggaaagaccaccaagcctaacaattggaatttaatccctgggtcccatatggtagaagaagagaaacaactccagggatgtctgtcctctgccccccacatgctgtggcacttaacacacaaaaaaatatactaaaaatacttaaggatcattaagatgactcaagtgggctaaagtgggcttaccaccaccaagtctatgacctgaattcagtctctgggacccatacaatagatagccaagtctcacaggttgtcttttcaactccatgtgcacatacaaaataaatgtaataggaacaaattaaaactaaggttaaaaatagaactaagggctggatatggcagcgcccagatgcttttaattccagcactcaggaggcaaaagtaaggggatttctatgagtttgagtgctacatagaccctgtctcaaaaaaaaaaaaaaaaaaaaaaaaaaaaaaaaaaaaagaaaagaaatagaactaaagatcggacatagtggtgcacacctttactcccagcacttgggaggcagagaccagggcaggtggattgatggagtggatagagtatcagtttgcctagtctgcaagaccccatggccctggtttcagttctcagtgcacataaacagaagccagaggaatcaaaatccttaagacttttcatacattttcaccatctaaggctggcctagaactcactatgtagcccagattagcataaggttcaaggcattactcctgcctcaggcactccagtgctaggactgcagacatgaaccacctcagtcagtttctgttcatactttttatagatgtctaagtgtgcacaccattgttagtgcgggcggagttcagaggacagctttgtagagttaattttctccttccgcctttacgtggatcctataagtaaaattcaggttgttaaacttgtacagcaagcacttaatccagctagcaatcacacaagaccctgtaagttttttgtactctaactgtattggaacatgtccttgaactctacagccccctacgtacactcaaagataagataagtggtagagcctgattcaaacatggcttaggccctaggcacaattcccagtaccaaacaaaacaaaacaaatgcagccactgagggagtatttattatcattgatatatggatacatttttaaaagcagattagcatttataaaaaataaaattttcatattgcatataaaaacatatgaaacagtaacagctaagggaaaaataatttgaacatgttgaaaagaacagcagaatgaagactcttgacacatatagccatgaacaggctactgagaatgaagtcagtgtatgaaatgattcctagccttacctatggaaataaattcaaactgaaaatgagatctgggtgaggaaggtgaccaagggttaacaaatggaatgagtgggactatgactttacagaaggtaacctgtaatatctgctaaaattttaaataccctctgtgagctatcatttccatatctagaagccaattcctcaaaaatgagtaagcagaacaaaacaaacctaggggaattactaaattctggtataagagagtaacaggagacaaggcagtttggataaggcatccaaaataaatgcaaaccagatacaaatagctcatgtgatcccttagaagatgttctgtctgatctgaaactcagagaagaatttaagtccacatcacaatcacagcaatcttcttgacccagacttccatgtgttgggattatagccatgagctaccaatctttatttcgattatctatccccccacccccaccccctaccccccccaaacccccttgcagggttttctctgtgtaacagtcctggctgtcctggaactcgattagaagactaggttggcctctgcctcccaagtgctgtgactaaacgtgtgcaccacctgcccagcccattatctatatttatatgatattgatatttgaaacaatttttcctttgtttttgttttgtttgtttgcttgttttgagacagggtttctctgtgtagccctagctgtcctggaactggtctcaaactcggaaatcctcctgcctctgcctcctgagtgctaggattaaagatgtgtgccatcacactcagttttgaaataatgttttaggggttggagagatggctcagaggttaaaggcacccactgctcttccagaggtcctgagttcaattcccagcacctacatcacagctcacaaaattgtaactacaggatctgacaccctcacacagacatatatgcaggcagaacactaatgcatataaaacaaaactgaataattttagatctctatgaattcgagccagcctgatctacagagtgagtgccagtacaggctccaaaacaatacagagaaacgccccccacaaaaaactttaaaatatctctgcctcctgagtactgggattcaagttgtgcacaaccatgacttactggcagattgagtgaaattttacttctgcatttaaaagttccctcctccctgcaagagaaaatctgtttttctaaaccaggcattaagtgcaccatagatccatctactccataagctgaggaaggagaagctcttgagttcagagtctgaagccagcctgcataatgtggtgaagatgggtccctcctacaaaattttcctacaatatacatgtttaatctctaatattaaaaaaaaaaaaaaccattaagctggacatactggtcatgcttatgattttagcacttgggaggtgagggtaggaggactaggaattaaagtcatccttggttacacatgtagctcagggacagcctgatgaaaaccaggcacagtagcacaagtctctaattccagcatccatgaggttgaggcaggatggtaaattgcaggccagcttagactacacaagtgttcccaaaaaacagtggaacacagctagtcctagaggtctaatagtcgtcactctacagtgaaatgtgtcattctctcaacttttccacctcttatgaggcatagcaccttccatcttatccatgttcccagctcagctccactcggaggatggacaaccacacgcttactttatattcaaacttcgtgtttgcaaagtgagttgacccaatttgcttggataggattaccagaccaggggtaacctttcactcaacaagcccaaggtcaacaaagacttaggtcaaagtaaggctatcttacttacaccggcctgtaacctcgagaaagaggtctttcctgaatggtgtcaggcacaggtaggtagtcaagagcagcaaaagcagaagtaagtatcaaagtatcaactataaagtgagaagaatgtgcaggtttggtccatgcctggaggatggtaccagctgaaatagatgggtcacagcctactctcccaggaaacctatgcctgggggggctgtgcagggaccttggctggagctggaggtgccttcaatggggcccaaccttgggctttgaagtaggaaaccagctgagtaggcacttctgcaagtacagtctgtgccagtgtctcccgtggagcctgtcagaagaagaaaggcaagttcaatgagggcctgtaggtctcccagggtctacatcttaccccaaattcaaccttgccagactgatgaaaaggctttatctgctggacctcaactccattctcatcaccctgcaaactcttcccatactcacattctgaaatcgtcgatagggcacaaactgtactatgtcacgggaagctgcttctccatagcgagtacgaagagggccaccatcagcatccagctgctccatgacctcaaagtcagcaccacccacgcccacaatgatcactgacatgggcagctttgaggcttgcaccacagcctcacatgtggcctccacgtctgtcacagcgccgtcagtcaaaatcaacagtacgaagtattgctagagaaaagttcatatactgaggaaaattctctttcccaacccctcccaacaaaccaggcacacattcccactaatgagatggcccccatgatacagtcctcgccacctcagcaccacagctatccgtagctcttaccgaggcagtcctctgctgtgccgcctgggctgcaaatctagccacatggttgatgatgggtgcaaagttggtagggccatagagacgaacttggggcaatgcttggcggtaggcatctacaataccctggatgcctacaaagaacaacagaaaattctgaagttgtagaccttagacctcatgggattaagtaagacctgaaatctgtccatctagacccagaagatttggaaacctgaaagtgttttacccttgtcactcaggacacagttctatccaacaaatgaaattaaaaggcgccagacagtggtggcgcacgcctttaatcccagcccttgggaggcagaggcagaggcaggtggatctctgtgagtttgagaccagcctggtctgcaagggctagttataggacagcccccaaagccatggagaaaccctgtctcaaaaaatcaaaagggcaaagacaacaggacttgatataaagaatatcttgtattaaaactaatattaaaagttattttctgaaccagtggtggtggtacacacctctgaactcagccccttgggaggcagaaacagaggcagaggcagaggcagatggatctctgatttgggggccagcctggtcttcaaagtgagttcgaggacagctagggccacacagagaaactgtctcaaaaaaaaaaaaaaaaaaagcatttttctgaactgggagaatggtttagcctggttatgttagtactttggaaactgagcaagaggattgctatgagtatcaagagagcctggcatacacagtaagactcttaaggaaataagaccagcgagatggctcagcaggtaaagagcttggtgtacaatcccagtgacatgagttctatccacagaactacacagagatagagggagacaactgaccccacaaagcaagatccacctgccttgtactcccaaaagctagggttaaaggagtgaactaccgtgcctagcctgggtcacaagttagaggctagcctgcatacttctaggccatcccagggtacagagagtctctgtcaagaagggaaagaaaaagtttgacagactaagaagacaatatagatttgaacatatatatgtaatatattctagggttataaaagaaaggggactatgaggtagaaggaaaaggtcttaaggtacaagataaggtaatggagccgggcagtggtggttcactctgtaacgataaatctttccgccaagccgcctgggccctgccgccacatggttgcccaaaataacacacagagattaatattaggtacaatgatgctgctcaatgactaggatttcttaactgtaagattagtcttaattatcaaccataactattaatctatatatttacaagacttatctaatagaggacgcctgtcttccttgctgccacatggatactctccctcaactacatttcccagaataatccttgattcctactcctacttatcttgctttcctattggctaacagtgctttattcataaaccaataagacaaacatatacagaaggacctcccccatcatcactcctttaatcccagcactcaggaggcagggacaggtggatccctgggttccaggccagcctgttctacagagtgagttccaggacagccagggttacacagagaatcccagtctcaaaaaacaccaaacaaaaaggcaatggaatatgtgacatgaagcaaattggggtactatttggaagggagggctaggggtgtaataagaagatatacgtgatatatatgtgtgtgaatagcacagacctataatcaacagttgggaggtggaaacaggagattcagtttgagactattgtgaactataacaagaaccagactcaaatgccaaaaaaaaaaaaaaaaaaaaaaaaagccaaaaaaaaaaaaaaaaaaaaaaaaaggccataataaaacaatcatatgctgatgaaggtttaataaaagtaatcagggtctgggatatagctctgtggtaaagcaaattacctagtccctcagtaacatagaattatttaaatacaaaagaatggccttgattttaggaaacatacttaagtatttggggtgaagagctatgtgaacgacactgggcacaaagttgatggaggccaacgtgttctgtataccattatcaaatactccagggaaagggacttttaaagccaaactcagaggcagtgaggcctctggggttaaggcagttgtcaccaagcctgactacctgagttccatccccagggaccacatggtaaaaataagaagacttccagaaagttgtgcaatgatgctcatgaacatacacatatacactgaatacacataatttaactttttaaaaatgtaaactctgctgggcactgtggcgcacacctttaatcccagaaactagggaggcagagacagatggatctctgtgagcttgaggctggccaggtctacaaagagagttataagacagctaggactattgcacagagaaaccctgtcttaaaaggaggagggaaggatatataaccccttctcttcctccctccctccctcccttacccctcacccaactaccctgtagctccaatgactccagaattcctgtgactgctgtaacttttctctaaggctgatgttttgttttgagccatgcttatgttatttagtcttctgtgactgctgttaacttttctctaaggctgatgttttgttttgagccatgcttatgttatttagtctagccttgacctctaatttccccacttgcacttcaagtgcttaagattacactggcttccaaatatggttttacatcaaaatacaaagtgagaagaaatttttagattgaagccatagccttgtgtggtgctcacacctgcaatcttagcacctacatggttgagggaagaaggatcacctggtgctcaaggctagctttggttagtgagttctagaacagtccaggtgagggtgagatccggagctggagcaaagcagcatgaactgctcttccagaggacctgagctggattcttagcactcaaaccaggaggctcacaaccacatgtaactccagctacaagagatctgttacctctggtctctgtgggcacctgtacttacatgtacacaccaacacacaaatagacacccatacatacaaagaaaaataaaaataagaagatcagatgagatcaggtcaattttttttttttttcactttaacttggtgctcacgtggaagtgctggcaagacccaaatcttgggtcttttgtttgtttgtttgtttttgtttttggagacagggtttctctgtggctttggaatctgtcctggaactagctcttgtagaccaagctggcctcgacctcacagagacccccctgcctctgcctctgcctctgcctcccaagggctgggatcaaaggcgtgcaccaccaatgccccggctttttgttgttgttgttatctcaaccaagtttttattgctctagcaactgcaaaatatacaaatttctgaaaggtgtgtcctgtttaaaagcttgcaaagcttcttcccaggcccttgagagagacaattacacagaacatgaagaagtcatcaatcacacattgaaaggccccaaaccaatggatagttaaacccaatctatacagctttctagttttaggcttccttatacatatttgataagtaaatagctatcaaaataataaaaaaataattttcaaatattacaaatgaaaatatcattggtgtgattccaacagtttttcttctcataaatgaagcaatgcccagctttttaatacattttttaaagacttattttgtatgagcattggtgtctgaactgcatgtatgtctctgcaagggtgtcagagctcctggaaccccaaatcttgggtctttacaaagaagcttggaaagttcccataaataactacctaccctggctggggatgtgtctagtcacagattgttttcccagtgtatagaaagctctggactacacccttagcacagcaggcagtgacagcccacctagcccttttccatgttttcatttgagaacacgttgcccaggcaggtcttgaacttttgattctcttgccccagcccctctgccactagccccagataactttagttttattttaaaaccaaagcacaaagaggtaagcaacttgcccaaggccatcagtaataagatgaatttaaccccactgggctagctctgacctccactcctctgtacaaagaagcaggctcctccctcctagtcccctctgcccaggaacactcactcccagtgtgagactgtgtctcactggagaatggggaattacctgcacagtagggattactgggattgaagttcaaggcaaattcatgtgagacctgagggcaagaatgaaaatgactcaaccaggtatgggttacctccagtattagctagcacacaggagactaacacttgaagatttcaaatttaaacctagcctgagttatatagtgagaccaatttcaaaaagcaaaaaaggaaaaacaaaaccccaacaaaaaccccaaaaaggctgggtataggagtttatgcgtttaatcccagcacagagggacattaggatttcagtacctttggggcagtctgaacaaaaaacaaaaagccaaacaaaaaaaagagagagagagagagagaaaaatgacaatctttctttccaccttccccttgttccccttttttgcctcctgagcccctccctaacacacactccaaacagggtctatgtaaaccaggcttgtcttgaactcagagagatccacttgccactgcctcccaaatgctgggttaaaagttgtgagccacaacacccagcaaagatttcattttatttccaacaggattttttcggtgttgccttggctggtcattacatacaccaggctagcctcaaactcacagagatccacctgcctctgcctcttgagtgctgggattaaagttgcgcgccaccatgtctggcaatcagaagaatgcattgggttccctttgaggccaagctccaggtagctagccatcttacaagggtgctgggaactgaagtgttcaacagccatgccacctctccaggtacccccagccctttctatgccaagacatgtcattcttggggggctcaagtgcagtcagtagagtgcatgcttagcttgcttaagaccctgggttcaagcctcagaactacaaagtcaaagcaagggcattctgatgtatgcccacgggtgcgagctatctggccctgcacctgctgtataccgcccactagaacagatctctgtatctctccttgtagctcaatgccaagcaataaataaatttaccacagactctggaattaggatcttgatactaaaacctagaatagagagaaggaagaagagagcttacctgccaattagggggtacctgggccccaaatccaaatgctgggaacagcttgtctctgtggagaagcagtgaggggatcttgagtctagaggctgagatgtgaacagggcatgggagtggccagaacctgaaactcacgagtcatagtcttgaaccacgctgcccacactccacagtgctgtcagatactcgttgactcctgaagggctcagatagtgcagggaatcaggagaggatgggtctccattggagccagtgaagtcaacacccacctgggaagagaccaagaatggaggtaagggcggcctaagccttaaggcctgatcacgtgcccctaggacagcaacttacagtaaagttgatttggcagcctcccatcacatagtccaggaaggaatactctgtctctacctgcagatgaaaccggggttaggccatggctactagcgggctagcatcatacagtccaaagcttagaactcagagcctgggacacatgggctgccatcttacccggcaagttttcactcggacagttccagagttcttgtagcttttctttttctgctgcttctcggggtggatacattcaaattcagcctggtggagagaaaaagtagggcaggaaaccaccacagcatcagctaaggacctaagctgcactggccagacgttcctatggacagcagccatcacggcccaccggagcactgtcaacagtcactacctaccgggactgcttgaagttgggccaaggtggtgtggaaggtaccaatgagatcatgtgacccgtcactgtcatagtccgagcagcgcacctgagggagagtgtgtgtttgtataacagagatacaacacagggccggcaagaagtccctccccagaatccgttcccttcatcattctatttacagttgactcctcacctggatgggtgtgcccaggtccccaccgcagaaatgctgaagaggaaccgagaagcgcttccatgtagggttcaggttgttcttgattacctggggtggagggtagtgagctctgagctggcccatgaagatctcccaccctctcctacccaccagtttttctccctcagttcccaaaccctggagattctctcccgtgccaaccatcaacaccacgagtcacacctcagatcggtaagtcaggtgccacttcccatcaccttggcggaagaactccaagaacggatcagattttcctaggaagtcctgccgatgccaaagagattcagttataagacttcagaagacagccagtgtcagccctctgcccccttaattctcagatccccatggcctccttccaaacacaccttcttgtctaggtttctagcttctacctccatggttactacccggttgtcctttaactcctgagctgaaacctagaaagagaggactatatcatctcatgaattactcattacataaactgcttccctgcccagggtttatttcttacagtaatggttccctgcccggcaggcttccccggcttcaacatcaagggtagagtcaaagtctggctggacacaatctgggggaaaatgaggtgagagaggcttcagcaccttagacagggtggggtcctgtgtgactggcacatccaagcttcttaatccctggccctacacacctgacctagggagcactctgctgcccctaagaagtcgtcatcccccagctccggtgtcttgttgtcaatgtcatagattccaaagcgcagcttctggacagtctcaaagtggtactcgacctgcagagtcttggagaacgcagggcttgagcagttccggactcgctcagtccggcaaagctgtaggaagaggccactaagcatcagtaacaaacctgccacccccaaacataaccctcccctccctcaatgaccttaaccttcaaggttcatctcacctcagcccaggtgccccctcccacatcctgtaaaaggacgcagagtgggtcagatttggagccgatgtccttgtcaatgagatgatcacaggaaatggacagctgcaccaaggtcacacagtgggccatctggagggagacagcagggtcaagcatcagggcctctcctccatccttcactgactatagttcccagcctgggaaagccacacgcaggctttacacaggcagcctggacaccccggaaccctaagtggactcaatagcacaggacacatttttgataacaaactctggctccagatgaatccttactctctaagtggtcttcatctcaacaatgctgtccagacttggaacttgagccttaaccactgcagagcataatcaatctctatctggcctcttagcaccttccccaaggtcagaacgaggctatatttcaattccaacagtttccaggggggccatcatctagatactgctccctaactgctgataaccataacctctaattctgggacctgacatcttgcaaattgggatccattccatccattaactcttcttatctctaatcagctgctcaggtctactcatttccatgtatgtcatgatctagtctaagctactgtttaggttacctagaaatggcaatagtttcttcagctgctcacttaacctcttgccaaccctacttccacttcccattaccacccagtggactgttaacatagcaaccaaacttatcctgtcagaacagtccatcacagcacacaggaagcagaagcaggactgctgtaagtgcaagggtcaccttagataacatacagagacttccatggctacaaagtgaaaccctgtctggggctggagggatggctcagaggataaaaacattggctgcttttccacctgaactaggtcctgagttcaattccaagcaaccacatggtggctcacaaagtgaaaccctgtctcaaaaaccacaaagtatggctcacactgtaatactatctctgggaggccaaacagaaggaataagagtacgaggccagcctgagttacaccgtgagtatgaagccagtctaggctatgtgagatcagaccagtgtgcaacatgagtggctcacatctgcctacaactccagctccagggggatccaatgtctctggcccaaacatttcgtccacggacacatacacatttaaagataacaacaacaacaacaacaaaatcctcactgatatcactctaagctgcacactggtctgatgtaccatctgaaagatctaggtccctctaatttaatctgccagttctctcgctcaatcattctggcctttgccatccctcaagcccactggattcctattccaaagccccgcagtcacaggctgctctttgtttttattacccacatagtggttccctcttctgtaaggttcttaccatcgcatcttaatgtaggtagtcttgcctgccactctaattccaaccctaccaccactgacatcagactccatcacagccttcacaccagtatccaacttactatacatattttagttatacaatcagtctctagcactaaaatgtaaactgtacaaaggagaatttacctgtttgtgcacctgctctatcccagcaactaaatacacttgttgcatgaaattcaagaggccatctccaggaccagctcacagactgacttgtctccaaatcaagcatccccaaacctctacagttcacctatttcctccatcacaatcatcactaccttgcatgaatcaacacagtaactacaacgtagttgggcctacagcccaggatgatccacaggcgacacacaccatctacacaagtctccaagattcctcactggacttgcttcaacagcccaacttcctacctagcagtgcttcctgggaggtctccagcctccttctgcccccagcctgtatcatctcacgttggtctctaaagtctcctgtttgttcttgttttatggtattgggaattgactagggccttgtgcataccaggcaaccatctgtcgctgaactatatcccagctctagcctcccacccagaattcagtacacaacattgattatttttagagtcacacacagcacttgctcaaatgagtgttaaaatccactactcttgatccaaaaggttgcaaccaaactaaaccacatgtgtatattctcactcccaccctggaggcctccttcttccccaggctctatattccatgtggctgcaagacagggtctggaagcagatgataaccccaacaccacacgatggcaggtcctgtgttctaaggctgctcctccaagaggcctgcagacttccaatcttcccaatgactcccctagaggctcaacagaccacagcttatgctgaattccaccattgtcagctcatgtcttgacaaaggatcccagaactcaggtagctcacaggtgtatcaactaggtgggctgtgctcaccaccaaacacaaaggaatgccgaatgcagatcaaccagaaagaaccaagtgtatacattacttgaaagatctagactgcaaagtctcaggtaagtgtatattcgatagatctgaatactctcacacaggaatatacacagggaaacagcatgtacacacacccacccctttgtattctggcacagggttccatgtaatccaggctggcttccaatggactttgcagatgagggtgacctaaattctagattctcctccctttccctgtgagtgctgggattacaggcatacatcaccatgcctgagctatttatgatttatacacttccttccgtatagacttgtacattgaaggccctcattagctccctacttaaccccaatacacagcctaagtatcaattattctaaaccctatacttttatcccacttcttaccctcccaagtttctcctccttggtactgcctcacctagccaacttccagtctcaacaaaaaaccctgtataactgcccgatgactgtaaacagcaaatgctctagcaagctattttgttctactcctaagggagaatttctacagaaattgctaagtctttcttagtcagccactttccttagctcttaccaataggagacaggtgagaacctacataaccaacatcttgatacccacagctctggtctgacgggactccccttatgaattcttgccagggaagatttcattgtctttggataactgcagtggtctccttaccagtctttctgcaacctcacagccatttctgtgtttactagctaaatgaaaaccagatcatgtcacttccctgtttaaaactctgggacagcttcccaatacattcaacataaaatcattcgatgtaaaaccctaactttgaaagcaggagagatgtctcaggggttagagcccttgtgtttccaggggaccagagttcagttcctagcacccacatcaggcagcctacacacaggtgcctgtgacttcagctccaaagaatccaatgccctcttctggcacgcacaggcactgcaatcacaggcacaaacccacacagagacacaaacctaagtacactaaattaaaaacaaaaccaacacacacacacacacacacacacacacaaaagcattctgtggctggcatgacagcttagtgggtacagtgcttgccattacctgagtttgatccgtggaacccatgtgtaaagagtcatctaaccacccaagtgtgtcccacaaggctgtccttaaccatccgaagcgtcaatcccattctccatctctgggtctttgtactgtatggttctatgtaagagcaggaactctgtctactttgccagtgtctctggtacctacttataacagacactcggtaaatattcagtaactgcattaatgctgaaattacaacagcagaatcgtatctttctctccccgccatttaattgtgggctcctccaaactagctctgagtatcatctctatatgcccagtgcaacaagctggtactcagctatttgatgaactcatgggaactcacaacttcacgaacttttcatttgaattaatgtacatctgtaaccttccctttcttgcttttttgacaactgagttgtgaaattttaatgtggagggctaagatgtagtatagtggtaagagtacacatatccctgggttcaacccccaacaccaaataaaaataaacgaaaacgaaaaccaaacctgtaagacaaaatttcaatgccagactcctacaattccattttaatgagaatcaagttaaataaataggcaaaagattcaaagattctttataaaacataaataagaaataagcttgtgaaatgatccacagcctaagtggcttgagaaatgcaaaatggggctggacggtgatggcgcacgcctttaatcctggcactcgggaagcagaggcaggcggatctcagagttcgaggccagcctggtttactgagtgagttccaggacagctagagaaacgctgtcttaaaaaaaaaaaaaaaaaaaaaagccaaaaccaaacaacaaaaaactacaatgagatagttagaaatccatccatgcccaacaaagcccaatgttggcaaaggatttaagattcttatagctggtcaaagtattaaatatgtcaccttggaagacagcccagcaagcctgtcagaaagccaagtgaatacctagctaagtgcaattccactggcagattttaatctaaaagaaatgaaaacatcatgtccaaaagctttattaggactgctcacagcagatttagtcattatagcctaaaacttgaaacattcccagtgctcatcaataggagaatgaatcgctatgcttatagaaagccaattggcagcagattaatacctgaaatctgaataaatctgaaggatgaaatgatgattttattcattagatttagaatagacagaaactatctatggtgttggtgcacacctttaatcacaacactcaagaggcagaagcagatctctgtaagtttgaggccagcctggtctaactacacagaagaaaccctattttgaaaaacaaacaaaagaatatgcaaaacctaatctttgctgtcctcctttctcccccaagggagaagtggttgttaactgcgggaagccctaggactccaggaaaagatgttcctttgggtcacagagggtctcacttaattccaaccatattactgtgggtccactgtgtggaaagtagcatatggggcctaactctgtgatgttactaagttggcctggcttctattctcaatgtcagggcttcctgtgcaaccaaggtttcttatttttgttttttttttcttcccacagatctgcccccttttctttcttattggaatattactgtgtgggaaaaaaagaaaaaccttaataacttgcagctttcactgggcagtgagaatcacatctacaatcctgtcacttggggggtagaggatggaagccagcttgggccatgaaactgtctcaggaatatggatatgacacacgtgtactcccttggagctatttcaccagcccccacccctgaagtgacttgctggcctgaagtctcaattctccttcgtctcaagcacagggattgaaggtgaaaaccacaataactacccatagctacttttcttgttgagctaagtttcctttaaattacctgtaatttatggcattaatttttcaactctttctcataagcctatccctgcttggaaatctgtggctaaaaatcctggtgcacttttgaccactgttgattactaactacacaccacttgagacagcatcttttcagatgggctaggctggtttcaaattcactatcctcctgcctttggcttcagagtgctgggattacagcctttgccactgtgccctggcaactgccacatactttacccagactcacttttcatatattatagtgccatttcaatcaacacgaggctttcattccaaaccccttgcatgtcacagtaagatgaatcagaaagtaaaaataagaaaatttatcatttaagagatctggttatgcgtactagatctttgtgtacagaattcctgttcaatcaattgtagacgccaaggaccttctggaattacttaaaacttgtttaatgctaacccatcaaaggggaggcgagtttgctggcacatctgacatagttagctttggtgtctcctctttctgttggaacttgtgcattagcgcagatgggaacacctataaggtaaagctccagccttctctgccttgtttgtggtcacttggggtctcattcctttcaaatctcctttatttgttgtttacctctcctcctactgccaacctcagagctttctaagccctgtacaattatatattctcccttaaagcaccatcctcccagcagggcacacctgcactcccagcataggcaggggatccaaggtctgagtccacaatgcaatgtgcttacatagaggatctatctcaaaaacaaatgaaacccccctcatctcctcccatcataaataaaatggattgactaccgagcccacattctgtgacccaggcagaatttggttaagtgaaatgaggactagaacacaaacatttggactcctgagtcatccttggaacttcggtttttttgagacaggatctcctgtgtggtcctggctggcctgtaacctgctatattggtcagactgacctcaaacttatgcctttgcctcctaagaagggtcgggattaaaagtatgcactttcatggctggcctagaactttctgtattataattaaactcccttctcttttgggggaaaatgtttttatattcactgtcaacctgatgaagacaaaagtatggacttcccaacagtgagcaggcaccaactacttccctcatttcttcctatccatcagataatactgtaccagatggtgtcctgcatatatagtttaggcaaaatgactaagcctcaggttcctcagctgtaaagggtttatgatcaacctctgaagattaatgtaaataatgtgtgcacaactcatataccacccttaagacttgtgctggaattgtcatcgtgttactcagccatcaccatcttccaagcctaactcaggcatgctgactctcccaagctccccacagcagcacgcaatgtctctggaggtcctgtatctaatctacaatgggcaattgcattctttccctgtgtgtctgcaccttcttgcttattgacaaacttttggcaccagggtctcatatagcccacaatggcctccaaccacaggaaagccaaagatggtcagtatctttttgcctatacctcccaaatgcttaattataggtcacaaattctgccagtacatcttagctgggcaccatagacctatattcaatggaaattcaaaacacttgggagaagctggcatcattgtactggaccagacttgtaagaatcccaagcattgtgtgagcaggtggccttggtaagttttaaggaaagactaaatgttgtaagcctcccacattgctccctgggagataggttatctgcatagcattgagataggactctcatcggtaatacaaaaattatgtgcctttcatgttttaaatgacattcattcccctgcattagcaggctctaattgctatttgtaaacccaaaaacagactgtgtcctcctgggttcagttgcatctcagtaccaaatggcctaaaattcacttatcagtcctttaagctcaagagttacatgagcctctccattcccaagagcttaaccaggcaactgtgcaatccctgtctccctttgtctaacaaggacatggcacagatgtggcagaggctggccacaagcaggtcagtctgagtagcaacagcatctcttcagacaactcacgtcatgctcacacctgatgtcgcctaccttggcaagatggagcagctcacagatgctggatcgagtcttggaggccaatcaggaaatcctccagaggctccagaagcactccccacccctcatccccaccctcgctgaacagcccttccccaagaatcaaaagactgagcccaccaacaccattttcattcccgtctcacttcctcaagggatatggaggaggcagctcttttcttacccctgaatctctctctaatttcagaattctccaaatttaaatcagcagctccaaaaacatttctcacaggtcacgaatttaatcaaataatttctttttgaggcagtctttagagcaagctggcttattggtctagattcctcttgcctcagtctcccacgtgctgttattaaagttgtaccccatcatgacccagtcaaagctcttactatggagtgacattctttattcccccccacgtgactaaggtgactaaggactaaacaaggagatttatttagatgcacgaatttctaagaagcctatgtgccacacagaatctggcagtactacaaagcttaaactgtgcacacacacaggaaacctaagtggagaattacagctgtttcccaccttgtactgggatggccaggaaagtctgaaagccactcatccaactctaacatccctgaagactaccccaaagccaaacaacatctcacctatgccggatcactcacagaaaaaaaaatctatcccaaagagagttggaaatggagggaagctaggactgctctagcatgctctccacccagagactcagaatacatcccataccaaacttgaactgcccacttcaaactcctgtctgatcagcacctgaagataacaggtagtacttttgtgtctccctgcttacatggagttggaaaaccaaaatcatggagcattgagagaggctcttccctagaagactggggatgtatcacagggccactgctagtgacttcagcccccacaaccatcaaggaaaaacaggtaacacttgtgtctaagaagtatgaagaattttcactatgaagtgaaaattccattcatagctgggcaggttcctagctcacagctgtaatcccaacattgaggaagattactgttttcaaggccagcctgggccacaaagtgcatttaaaaacctctatccaaacagtactagcaatagaacctcaggcaagttagtttccctttctttatagattcccctatctataaaatgagtggtgatggcaactctagaagttaagctcacccttaaaagtgaccaataataaggatcccttgatagtgggatgcctacagtacattaactctcccatttagcactcacaaatgagtaaatgtgcctttgctccttgtttgctcatggaacacttaggacaggctatgagactgacaatgtagggtttccgccatgcagaaaagagaggggtcacaaagtagccaaatcaaaagtgctgaagttccatgcttttagcttctgttcagggccaaactcataatgattgtcaaaagaaatggaatagctgggttcacagaaccatagatgcaaaccactggataggataatccaaaccttcttttatagaacagaggccaaaggacacatttgccatgggtcacaagaactcatgggagcaaaggggatttctctgttccattctgtcactagttcacatcctgtagttcagtccaatcttagacagttcactattgtgtctcaaacacctcttcttcatggcctatactaaccagccttatacaaagatgtaaaggaagtccacatccaccacaatctcattattggaacaggaatggagggcttgctggactccatgtttataggatttcatagggacaaattttaaacagcaaacacaaatagtaaataaacatgtatagtaaaattcatcgcaggtagtcatttctggaccccgtcctaccctgctgcaacttacatattcaatgcctgttatatggagtgctgtgaaaccaccttcctgagcatcatgagggcaagggcatcgccaaaaaccatcgcctctacagtgtgcatgcaagtttaacagcacagcaaaccaaagcctgcggagtagctaacttaagtttgttcacagggcatgcttccctacccgacacttgaacaagtcacttggttggaatatgtagaggatcttaagactgttctctaaaacttctgtctggaaaactaaaaatttcaacagggaaactgtagaataaacacaaactagtttcacatgtgtcaagtgtccagaaagcctttacacagttcggtggtacagtcagatccaagcacaactaagcacttaagtatgtgaatttaagaatctaatctcttgagaaactgacatctttctgttcaccttcccaccattaagtcctgttgtgctcaacacacaacactgcccccccaaaatttaggacaacatatagatatggctaagctgtagttacaagaagaccaacagaagtggagttctaccatgtaagaagcaaagtggtatctactgtagcaaataaccacctgagcaagtctgtaacctaggggcacagctggtcccgtagatcacaaggctaaagggaagagcagatgctgtgtcagccaactgtccaattgcagcctaacagtatagaacataaggggagggaagccgaactcagagtggagcaagacataaggaaatcagtagccgcatgttatatgttaagactgttcaagcagctcaactccttcatccttttctttcccccctcgagacaaggtctcaacatgtagccctgcctggcttggaagtcactatgtagagcaggttgatccagagtgctggaattagaagcatgtacaatgaatgaccagtctttcttaagtgtgaaaatttaacagcttgtggagtgtatggcagcacattgtggacactgtctggtatgaattatatttaactatctttagcaatcaaaagttccaagtaaatgtcaggaggctacattctgctgagactcatcacctggtacccagatgacttgctatgtcagtaggcaaaacaaaaaaactgaaacatcaaggggccggcagcaactcctgggatgagttatgctgctgcttcccctctgtacttgttttttttttctccttccagattagtaagagactcaaaactaattgttccctaggccagagtctaggtgtataatgggggtgtgtgtggcacacataatatcaattctgccattcacccttctctacaacttatgtcttaacctctcattggagggacgttcccagggcttaagagaaatcaaaggacataatgagatttttctcccctgctacacacagactcagtgtttttgaagtgttgtcctatacctggggctggactgtttacatcagggccgtgtctcctggactcttcagtagcagagccggtatttagagtatgctcttggctgtgacatgttgatccagaaaaaaaacgatgcttttgagactctgacagcacaaaacagcacaaataagtccagaagagcacactgagaattaccatttaatagattaacttgcttatgttgttaaacataaggctttttttctcagaactgtgcttaccaacgtactgtgctaccaaagtactcctcaaactatcttacagtaaaccttcatgagcttaaagagataaaatcttagctggaagtagtagcacacgtgtttaatgccagtacttgggaggcagaggcagggggatctctgtgagtttgaggccagcctggtctacaaagcatgttccaggacagcaccagggatgggggtggggggcagagatctatatttagatcctatcatatccctgaagtctattttggggagagtagtgatgggtatacataaccaatacactttcttctgaaaagctagacaacagcaaacaatgtgttacagaagtgatctgtcctgagtccactcctctcagataaagtcacactgtgtatgcgggggttgctgatctgatctgtttttaagactcagaccaggtgacctgtatctactgtccagttactccgaaagctgaggtgaaagagtgcttgaacccatgcctgggcaatacagtgagacctagccctgtaataaataaaatcacttcattgctacctggaattatgtattggtctaagctcgtctcaagcaggacatgtagctcagtggtagactgactgctcagacattctacaacactaggaaattcaaacataagctaaactctgatgtgataaagacaaaaattacgagcattttctgagaactttggttgtagggaacagcccactaattctttcaactctaactcatccttttaaaatataaaccagcagtctacaacaacttcctttactaattttcctaagttgaacaaatgtgaaagggacaaaacccataacagcgatgtcacaaagcaccaattgctttggctcccttttcttccccaccttaaacccatcgcattgaaatacaaaaacaaagttttaggtaggtggaattaagaatctactccaagcatttctttaccctttcccactgcaaccagtatttggaaaatgagagttcacagaccccttggagactcctgttgagaaggagtatctggtcctcaagttctttccaaatccacataacgaagccattagctagcaaagcacacacaataaaacgaaattctgaaaaacgaggttcgcacatgtgacctagaatcaagtttcctccctgccgtcccaggcatcttctttccacacttcagcattaggcgacaaaaagacacaaacatttttacctctaaaatcaccaagtccacatttccaaaggcaccaatattgtcatgagttaaaaacaaaaacccacaaagtggtattagagctgaaagacgtacttttgtgcagttaaagcattcaaagcatcagcctttattttgtgataagtttattgaacagtatccaagacttcttctttatcaacaaaaactgctaaatgatgccagaggaggaggtgctggcaatgctgtggtcacactgtcaacagcctcttggctgtactgaggttctaaagtttggactacagaactgccaataaaacagctggaggaaaataatttacacatggcattgtaagtgggaaaggactcaaaatgatcacctctagaaactctcccccaaaatggactagaagtcattttacatgttcttcactcatttttccagtgcttttaaactgagtgcattttattttcacacttatacaatcacagaatccagtaaaatggagtttgaatgagcttttgtgtttccttatttttgtgcaaggtgatcatttcctccaaaattgtgtatgcttgcttacttccaaatatgtacatattcctagattttcatcaagtaggtcaagactgaccttaactacactgaatattactatctgtaagtttgacatttcctagtgcaggaactgcatttcacttaacactgttgcattaaaacaaaacccacaacagccactaataattgtacatccaaactagtataatcacagaaaacacctccaaattatgcttatgagctaaatctgtcactgaaaatttacagatttgcttatttataaaatacatttgtaggtttcactaatcctttaaaatcaaaagaaaaataaacaccaattaaaaactcaggagaaaacaaattaaacctaatggaaaagattctcttccattaatgtcaaagtcaccaaaaacagtaagatttacacatgaaattaagaataccttgacagtgtttacaaacactctttgagcaaagctttacaaagccttcatgccatacagatgagaaaaatcaagtaaattcaatctataccaaacctagttctggagaaaatttgtctgtcgagaggtatgaatagtttcatggaacacattttcatggttattaaaacaaaactgaaacttcaatgcccagaacaagataaaacaatatactcagcagttaggtctgttaatagtttcagttatacaaaaactgaagttccagacggcagagttatttatatttagtcacatttcacaacaagcactgttgtgatccaaggagtgcagaacacaattctctctgatttctacaccaatactatgttcttaatttatttaatgaacagtgagatccaagcttttctttttagcatttatctaagatgtagaaataacaaaacagttgtaaatgagtgaacgaaatatttggtcagtgtgtaggaatatacaaccaaaataacttgtgagaaaggataaaagattttcaccttccaacaacccaatttttctaaaatatagacagctttccaatgggaaaataacctgcagttgaaatacgatgcccaagtagttctgaagtttagtctttgggatgagaaatgattacttaacacaaaacatcacatataaacatattgctttttgaggcagtatctatctgtcaagcaaattatatctgttgagttactaagtgattaacaatgcagccacttctttccaaagtctgcacaatcctttccctaaacaaaaactccacactatcaaccctccaagactatactagtgaataggctttccaaactttatcacaagactgttgccattcaactctagagttacacgacgaaactgtatttccgtgttccactgccttagaacaccaaaaaggcactgtgtatagacatacataaatgtctgtgtatatttatgtgtatatgtatatatacatacatacacacgtattcatatataagtatataagaaatgcctcttttaaaagtaaatacagacttgtaaataatgttggtgtgtttcaaaccaaagcaaggtcatatgaaagataaaattgatttcccatgattattcattaatttccaattctgtgttacgttaatgtgaaacagctttcaagcattttaaattaagaaaccaactctagacagagccttaagtgtcagtgaacaagatgtgataaaccaaatacttttatggaaaggatacttagccaaccaaagtctatgtgacccccccccactttggtgccttgattgccaacaggaaagaatatgaaaacgcaatgagtgacctcagttctcttgtccgatagctgtacttgtactttgcataaagaatattagtgaacaggctcatgatcgaacaactacaccaaaaagcctccaagttaacagaattaaacacacatcaacctatggtccaacttagggatcttacattctacaatactactgctaacaaaactaccaatttcaacttcagttttaaacccccaagatagaatgctctttcttatggactcctttgttccaaaatgtcacctaaattggggcaaaagccatttgctaggttagtccatcacagaaaggacttcaaatcaaacacctaaacactgattaccaaagtggtttctggttttcactgccatccaaacaatatgaacaattttaaacgtactaaactaataaaacttggcggtcaaaccaaaaaaggccagtagaggactacatactttatttttatggtaaaagtcattccacacaaccataagtgtgacattagaaatcaaagttcagggttatatagcacaaaccaagtgtggagtttttatattagaaattaattaaaaacaaaatagttgtactcattacaagtgagtcaattaggcaaataaagtggcaacatctgaagcaggactgtctatacagcaagaaccctcaagaagcaataaaggtacatacaatgaatccatatacagactttattcaatttaaaaagaaaatgtaggttttagacaaagctttgaccctataacaaagcaaatatgtccaactttaaatcgaattgcaaaagtagccaacttctaattgtcagcaactggcaagagcaccctcctcgagctctacttatgtttctattttcttcatcccatgtggtataaaagaaagccaatctagatttccttgataagctttatatgatcatagttttagaaatggtttccactggtatgccaaaaattatttttgtgttctctccagatagctttacgaaacaaattgcaatgtttaattctgtgagttgtaaacagccaaccaatgctctgtgttatagaaaccaatctatctgcaattgaaacaatccacaggctctaacctggaaatactatgaaaacaatctggatgcattaatcacagcaacatgaagatataccctataatgtgaaccactatcctaaaacgagctttacctttcttgaacctataggtctatcatttaagtcaatgacagcagctgtggcttcgtcccgagattcaaaggccaccatggcttcacctgtaggcatacctttttcattgtattttaaacacactgaacctgggattacctgatacccataaaagaaatctaaaatttcatcaatagatacagtaaagggcatgttctgaaccttaattattgtaggtcctggttttccagagctagctccaaagccagggggacccgcaatatgtattgggccaggcccaggcccaggcccaaaggctggaggcccactcaaatgcccagggacacttccaagactagggggcccacttccaaaaccaggaggagcatttaaactaccagggccatttccaaaattctgaggaatgcccccaaatcctgacggcccacttaaattatttggtgctcctccaaaacctggaacttccagtcctaggccaggcaaaccactgtttccaactgaaggcataacaggcctaacatcaccaaaagccccccctaatcctggagggggaagtggtggcccaaaggcattcggcccgccaaaattaccagggaaattaaatggcggcccattattggcctccttcgatcctacagtcaagaagacatgctcctctcctcctgcagtggggatgccagcaccaggcagtgcaggaccaggtattgcgggaccaggtattgcggcaccaggtattgcagggccaggcattgcaggaccaggcattgcgggaccaggtattgctggaccaggcattgcgggaccaggtattccagcaccgggtattccggcaccaggcattccagcaccaggtattccggcaccaggcattccagcgctgggcatcccagcaccaggcattccagcagcgggcatccccgcactaggcattccagcacctggcatcccggcaccaggcatcccagaaccgggaattccggcagcgggaattccagcagcaggcatccctgcactaggcatcactggtactgcaggattacctggaacaggtatctttaagcccttttttccttgggctgggggatttttctcaatctctcgcatatcttctagggtaactatatggacaaaagcttctctcccattcagctttttacggtgtaagtgttcagatttacgtgcatcatcttcagttttaaactgaaccaatgcctgcccaagaccttgcccattgttatcaacaagaacatggacagcactctcatccaccgggattccttctaggaactgaagaacgtccatcttggtaatgctgaatggaatgtttgttatatgggcacagactttggcagaactgacatccccctctggatttaacaccatttccctctggtcatagctgaagttttgaagtcgttttcgaatcatatctatcttttctagcatacctttcttagtaattggatgaacttgaataaagcgattgcccatgtattgtttatgacggcacagagcagccttatagtcagcatcattcctgaattctacaaagccttcaccagttgctttcccattgggtccataagctatataaatactatcttccacaatatccaacttcttaaaaaaatcaatgacgtgtttgttttctgcttcaaatggtagcccttttaagtaaacacaataaccagcctcatgtggtgatcttgaccgtgaccttttctgcccactgggcgattttgaccttggaagtgtctgtggaggggggtgggcttgtccagaaggccccatgctttgtttgaaagtgatatgacctccagcagctacccactgtctctctgtggcaggactgacttccacatagcgttgaatcatcagcattctgttccgtttcaaagcttcaaatgtatcttgaggggagagaaacttaaccaatccattcccattatttcgacctacatgatcttttaacaaatgcactgcatcaacacggagcccatggaaaaactctctgacatcattttccattgcagaaaagggcattccgtgcacactcacatacagatcatcagggttgacgggaagtgacttcacgctgctttgagagttcatctggatagggttaacaggagttaatggacccagaaacacagggttcagattattgttcagactcataggtgctccagagccattcattccagcaggtagaggtgccacaggtggtggattcaagggtggcatgcctgacatgggtggcaatggggtcataggaggcacattagggactgggggaatgggagggacaggaggcacaggaggcaatgttggtactggaggaggaactggtattggggggatggatggcagcggtggcaaagatggcattgctgggattggaggaatcggtggtggtgggactgtgttcattggagaagctgtactcggaatggtcgagctgaaggttggactcccaaacgaagtccccatacttggaggagcagatcctacgctggctgtggaaaatgtctgtatatttttgttgctctcatgaacagaagtggtagcagtaactacacttggcgaaggattattaaagttgggtactgttgccggcaagtttaccctgttgctcatccctgagctaggtggtggtcctgatctactagcatttgctggtggtatatctaagttggcagtttcaaaacgcctacgactcagttcaatcatattctgcatttctgttttactactcaataatagtgttacttttgaccctttaattgtaccacctgtgcgcatcataccaagccttgcatcttcatcagtggcaaaaacgatgaaagcctcacccagttcaccccctacaatatgcacgcccccatcagggatggtcaatccagagaagaagtggcgaatgtccatggtccccgccacaattgggagaccttgcaaacggatgaccacagccatgctgcgctgaaaccacacacacctgcagatgagaaaaggcaacggccatgtcagactcctttttattacactgaatttttagttgcaagaatgaccagctaccatattatcccataaacattccctcaagctatcacaatgtctttaatttagatctgaacaattacaacttccaaagactttaattctagagtcagttatagagaggttcagtccaagactcaagaaaaactatgtaacaataaagtcatcataaaaactatgtaacaataaagtcatcataaacattcacagcactaaaacttcagtcagtgagatttaaaagaaatgcataaaaatctatagaggggaatcatgcaaaggatgcatcaaaattaatatttaaaactgatttagcatctttcttttaaactttacaattttatagttttatcagagtgataccttataaggctcaatctcaaaagccaaaagaaacagaaaactggaatgttcctggattacaaatacctattgataattaggttcatatctcaaatgaaagacatatctcaaatgtgaaagcattcacaagacccagttcaatacgtagcaccagaaatctcaaataacaaattccatatttcatagtaaaactttcgatttgttctataaaaacaaagaactatctggggctgtgaagatgattcagtgggtaagagcacattctgtatgtccaactgtaagaacatgagttctatcctgcatccacatgggtgtggctgcacacatacatctgaaagtctagctggaacccccaactgtcagcctagttccaagtatagagaaagatactctcaagagaataaggcacagaataatggaatgcctgacacccccttccagcctttgcctgtatacacaggcttatatacgtatttatgtatatgcacacacatacatgcatgcatcactcataaacactctttctgtatttattataagcaaagttaatacatattaagaatccaaagaatactaaacagaaaggtcaaattctgaattaaccgtaatatatcaccctaaaatggaacctatcatacataccattattcaccatggctatttaaccaaaactcaggtacagagactgtatcaaactctgcattacatctttttttaaccactttttataaaacaaacaaaaaaccccagagccagatactgtgggattccctttaaccccagtatgtgagaggtggagttctatgagtttgaagtcattctgactacaaagagctccaggccagggagagtttcacaatgagactcagtttcaaagaaataaatatcagttggcagaatgtttgcctagcactcataaagctctaggatcctcccctaattctatataagctcagtagggtggtgaatgtcaattaccccagtacttgagaggttgaggcaggaggatctagaattcaagagcaacaccacagattacacacattaatgtataattcactatttgggcatctgacccaacttaactcctgttgaatctctggttgctcactgatacccttatacagcaaaacctgtctcaaaaaataaatgaaaggaagacgagaagggggctcagtgagatggctcagctcactgacaatactgaagacttgagttccatccctaggacccttacagttaagggagagactcaactcccacatatatacccacacgcacaagtaaataactgtaaaatattaatagggttcagctggagaaatggctcagcagttaagagtgctcactatccttgcagagaaactgaggcccagcaccctcatagcagctcacaaccacctctaactgagctccaggagatctgatgctcgtgtctgtcctccaggagtaccagacacatgtggtacacatatgtacatagcgaaatactcatatacacaaaataactccttaataacagtaacagggcagacttgggaggcagaggcagacaaatttggctgtggtgacctacatgtttaatctcagcatccaaaagtcagaggcaggaagatatctgtaagcctgaggccagcctggtctacagtgagtttcaggacagccagagctgtatagtaacaaaaaacacaaagtagtaataatatgggctggaaatgtagcttagttggtagagtgtttgcatggcatccatgtggctttgggttcaatcccatcagctcataaactgagtgtgaaggcatatacctgtaatcctagcatgggagggttagttacaggagggtcagctcaaagtcatacttggctactaagtcaatttaaggccaacttgacatacatgaaattgtttcaaaataataaagggactggagaaatggttcagtgattaagatcacttgcttttacaaaggatccaggttaagttcccagcatccacgtagcagctcacaaccacccataaactccagttccaggatcttcaacaacttcttcttgccttgctaggtacatacacatacatgaaataaaaataaaattttagaataggggcagagagatagctcaacagttaaaagcacaaactgttgttctagggaatcttagttcaattctaagtatcatgttgaaggcatatagctgctttcagccagtcccaggggtcaaatggcttgcacaagtacctgcactcacatatacaaaaaacacagacatacaaatataaatctttaaaaaattgtatttaaatatttttgaggaggggctggagagatggctcagaggttaagagcactggctgttcttccagaggtcctgagttcaattcccagcaaccacatggtggctcacaaccatctggaatgagatctggtgccctcttctggtgtgcaggcatacatgcagatagagcacttgcatacataaaataaataaatatttaaatatttttgaatctggattcaagattttcaattatttattaatacattgttcctgttgccattgtggtacctggtagcattaacactttagttttgggttttgtttttttttttttaattatttattcttaggaacattttgcctgcatgtatgtctgtgtgagggtgtcagatcttagagttatagacagttgttagctgtctatagtttagcactttagcactttagttttaaaggcttctacttttaatttttttgtttttgtttttgtagacaggctttctctgtagctttgaagcttgtcctggcactctgtagaccaggctggccttgaactcacagagatcccacctgcctctgcctcccaagtgctgggattaaaggcctgtgccaccactgcccagcaatggtttctccttttatgaaatgttttggaatcaaattttggggactggaaaaatggtaattttgaaagtaatctgatcaatcaagttttaaatataaacctattaacttggttctgagtcctcagagaaatttcaattatatgcgtgatctagcttaatcacttctcaagaacattagaaaggacaagatttcctgctataagctctaagacttaatacaaatcaatggagggaattcttcaatgtcaaatactatacaaactataatttaatgtaataaaatctaattatatcacgattttatgattactgtgtgcaaaatagaaatatggttttgatggctggattttttcctatttgtttacacagacacacccctgttgttgtttttttcttttgagacacggtcttactatgtagcctcagaaagcctagaggtctccctaaggagaccaggctgtcttccaaatcacatagactacctgcctctgcctctacctcctgagtgctgggattaaaaggcataccaccattcctggctatatgttctattttaaagctttctgggcagccaaaaacaaaaaacaaacaacaacaaaaaagcccacctcattgtttactatacctgaagaaatttcaaaaatcaaacataaccaaatggtatatttaaaatcacattctatttgtaaacagttaatttaaaagctactgacctttgcatcttaggacatacacagaaccaacacaatgaaatgacaaattctgcactgataacatgcttactggtttccttgctctctcctctttgactacgcaagtatgatttccttatttgagacaatgtctcatgaagcctagcctactcataaactggctttgtaaccagaggaccctgggttctcttgcctttacctcccctagtgctgggatgtgctacctaatacccagttcatgtggtaccggggggttgaaacaatttgtgcttgctaagcaaatactctactgacttacattctctaccccttcatagctttcctcacacaattacacacaaagataaaagcaatcttcaaatttaatcaagaatgacggactagcacctagaacatattttataaggctatacagagcactagaaatggaggtagaatgggtgagtaaagatttcaggtatggacttcaagagtcaacaaagagggctggtaagatgatggctcagatagtaaaaacctgagtttgacctctgcaatctacatggtagaaaaagacaactgactcccacaagctgccctatgacttccacaggtgtcactgtgagcgccagcactctcagaaacacacacgcacaactacaaaagagaaatagaccaatagacttaacaggcaaatgtaagtttaatcagaacatttccaagtaactgaggcaaattcacattccttactgaatcggaaacatgtttaagtgaaaattgtggtggcactcttttcaacttcaaaaatatgttccatcactttctatagaggaaacatcataggtaaaccagatatgcaatacctagggaaaagatactttcctttgtaattgaagaataagatgagaacttgaaatggtcccaatacacagacagattaaacacaagcataaatgacattcacagtaagtttctaaaccatattgttaagagatttaccaaaagtcggtacaaggcatccatgaaaacattccaattattaataacctgcctaagactgccagttggaaaagggatggagaactgaaccaagcagagtacaagatttgctcctaaagctatctgacaacaaacactgaaagtatgaagtgacagctgttactctgctactaagtatctaggtatctgagtgacagcaagtcttaaccagtcttgagtcaatgaaaacattaaatccaattgctaaggtttaaaattcgcactctacaaacctaacatctacacctgtatttctagggaatataaccatatcaagaagcactgaaatccacaatccatctgtaatgctacaagggagggcgcaggagcttactacctagcaataagaaatacatccatataaataaaacactttcagaggaggaaattattcatcccaccctatccctcagataggcttctaacactaacacacacacacacacacacacactcacactctgctatatttattttcttatttcttaataaggtatctcattttattttgcataaaaataaaccttctattcaaaatctcttaccttgtaaaacaagagatgtattttcttaagaagtagaggccaagtcaatcctgtgggcaaccaattaaaaccaacttttagactgcaatagagaataaatggaggcaaaaaatcaatgcaggaaacaaaacaacacacacaggccacactgcactgtacattatgaaggagtctgacaccagtggagtacttagtaagaatgtatagttttgttgttttttaagaaagagataccaaaatcccacacttgctttcaagtctgagaaccattctatcaaaaatatgccatcaggtatttatataaatatgccatgtagccaaaacataaatataaaaacagtacacgctcagcttcagatggtaattatcactcaatgtttatacaatccagaaatgccataaaagtctattaacatgtccaacctcaacttatttcctaagttctcaccaaacttctgatgaaaagcaaatttacataataacaattcctgaactgtcatcaggtcagggatattcacagaaaccactataattactctttcaaatatattacctttgcatcaaactatcacaggtcacaatacaactgaaatcaaatttcagtctctaagcactaattccactatattcaacagagatttctttgaacgtaacaacaaaaaacttatttaaaaagttatctaaagcatatctgtaacctcagtcagcatcaagaagcaggagctgaaatactacttaagtctgagactaacctgggctacatgctgagttctaaggccaacctaagccaacaggaagtccctgtctcaaaaacaaaatatttcttcagcaaatgtctaaggacataataatactttctaaatcacaaacggggtagcagagtacttatctttcagagtaatttcttctgtactagtgaagttattaacaattcgcaagcaacacaaacaaacaaataactgactatatttcctttttttttaaatgtacctagtctgtacaccgtgagcatggccagtgcccagggaccagaagagggcttcagattccctgagactggagttacacacagctgtaaactgtatgtgggtcctgggaatcaaacccagatcctctaaaaggatgccagtgctcttaactgctcagccctctcttcaaccccctgattgtgtttaaaaggtcattttaaaatgcatttttaattttaactgttttggggggctaagtgggtgcaaacagtcccagactgaatctaagcctaacatattttaggcaagccctctaccactgaactctatcctcagctcaacatatctaatttctcaatttattgtacggacacatgcaaacatgaatgtatgttatgtgtatgctgatatatatatatatgccaaaaaatgcatgtggaagctacacaactctgaaagttgtgggtcccaggactggaactcagttcatctagcttggaatcaagttgaatcatcttatcagccctattattttactttttaaatcaggctggtgatgcttctggctcaaatacactagttgttcatttttgttttggggacaagtgtcaggtagtcaaacctagtctcaagttcaggaagtagctgaggctggacttaagtactaatcctgtctccatcccatgctgacgcctttagtcccagcactcaggaggcagaggcaggaggatctctgtgagttcgaggccagcctggtctacagagcgagtgtcaggataggctccaaagctttacagagaaactctgtctcgaaaaaccaaaaaacaaacaaaaaaatctgctggacgacggtggcacacacctttaatctcagcacttggaaggcagaagcaggtagatctcctcgtctgaagccagcctgttctacagaacgagttccaggacacccagggctaacagagaaacgggtgggggggtggaaatctgtgttcttggggaagtcagaagagcatcttgggtttcagtccttgcctttcaccttgagaaagagcttctttgtttgtttgtttgttttacagctgcaatatatcaggctagctggcctgtgaacttcccaaaactgtttctaccacccatctccccataggagcactgggattacagatgtcattatctctcttttctttacatggactctgagaatcctcatacttccacagctttatgaactaaaacaccatcccagacaagcaaccatctttaacttcagagagtaagaaaaccctaccactctctggtactaagattaccaacaaaatcacttatctgaatgatgatactcattgttaaaatactgtgagaccaagtaagccacagtaataattttttatcaccaaaaagtaaaacaaggcaggcagtgctggtgcatgcctttaatcccagcactaggaaggcagaggcaggcagatctctttgagttcaaggccagccttgattacaaagcaagttccaggacaggttccaaagctacagagaaattctctctcgaaaaacaaatcatgttattctaaacttgtctagaggaaaaagcaaatatcttctaacaatttaaaatattatacaatgcactttgccaaaaaggccaagcttttaaaagcctaaagtgcatacattaatctttagaatgtaaaaatctaactgaatataaatctttgtcaaatcactgtgtacatgttcatgatacatgtgtgtgcacatgtgccatacagaactgtgtggatgtaagaaaacaactccatggagttgaatctttccttctaactttaggtgagttctagggatgtggcaagagccttttaccttctgaacaatcttgacagctatgttttcttaaactcttcatttaattagtcttatttccttcctttattgatgtgtcagaaaaaccacaacgtatgtgtgtggacgtcagaagacaacttttggccaggcatcagtggtgcacgcctttaatcctagcactcaggaggcagaggcaagtggatggatctctgtgagtttgagaccagcctggtctacaagggctagttccaggacagcatccaaagccacggagaaaccctgtctcgaaaaaaaacaaaaaacagaggacaacttttgggagtcaatcctctccttctatgtgggtcctagagattaaaattaggtggtcaagatggataacaagtacttttactcactgagtaatctcacagaccctaattaaactcttcattttaaaagttgtggtggtgtatacctttgatcccaacatttgggagactgaggcagacagatctcctgagtttgagaccaacctgttttacaagtgagttgcagtacacttagggttacacagagaacctgacttgaaaagtacaaaaccaaaaactgtacctagggaaacagaaaacagaaagtttgcttcaaataaagcaaaaaaaaaaaaaaaaaaaaaaaaaaatttttttaaaaaaaaaaaaaaaaaaaaaaaaaaaaaaaaaaaaaattatggcaatgcatattatgtctaattgcataaagaatcagccttaagagctatagaaccagagtaattttgtagattggttggttggttggttcctaaacatctgacacctactggagatttaattccaaaggtctggcacagcagggtgtggcagtgtatgcctataaactcagtgctccaagaggcaggaggacactcagttcaaagtcagcacagacaacatagagaattcaaatccagccaggatatgagaatcttgtctccaaaacaacagagtaggaacaaaacagaaggcaagggcctgggcatatccccaaatattaggaactgagtttcctaatgcttgtcttccctttcagacacaagacattccacatccatccagaaggataaatttaggtcagccagttatgcccaaagggaactcccatatctacaaggttccaagaaattaataaggaaaattcttattacatcaagaaatgttgaaagcccagctaatctcagtaaatgtgtacttcaaattttgtgttcaactttacagcacaaaaatcaatccccacacaagtaccatctgaagcatccagtgccaaggagaattgtacacctcagggctaaataccacaactgcagaaccttttctaccacagctcttccttcacaagtacaataattggaaactgaaaatttgtagcacttttgtttcaactcctcactttgtagagaccagctttgtttatcagttcaaaaattatttgtgttattcgccacccagtggtggcacacgactttaatcccagcactcaggaggcagaggcaggaggatctctgtgagttccagaccagcctggtctacaagagctagttccaggacagcctccaaagccacagagaaagcctgtctcaaaaaaccaaaaaaaaaaaaaaaaaaaaatgtgttattttatgtatatggatattccgcctatcacatgcacaaagtacaagtagaggccagaagggggaatcaggaatcatatcccctggaactggtggcacagcacagatggctctgggctgccttgtaagtcctaggaattgaacaaccctggtcatctggaagaatgaatatatatatatattgattgattgctgaggcatctctccagccccaagaggtagtactgttttccaagaatctacttgttcctatatgttaaaatatatcagctagtgcctaactgaacacaggattccaaactaaaatctatcccactcacctgataatgacctttggaaggacgtgagtgaaataatactatgcaaaatacaaacaaccgaaaaacagtattgagccatatgtgatggcatgtgcctttaatcccaaagctcagagacaacagtcaggtggatctctggtgttctgaggccagccttgtctacaaaggagttcaggatagccaggggcacacacttatctcaaaaagataaataagaataggtattgtaacgagacaatgtacacatgcaatgctagcagagtacttaggaggcagaggaaggaagactgagagtttaagataagttatcttataaacatacacattttatctatatagagagacaggcaaagagaaaattgaccctggtttgccactgatccattgctctagtttaaaatacctaaaacaagcttgtttagtgtatttttcatttcatttcctaacatatgttgcttcaatacaataccagatacaaacacaaactaagtattttcgtattatgacaagataaactttaccagccattccaattatttgaaacttcaaggtaaaatgtctatcaacaaacctttccatcatgaagaaaaggtataaactaattctccagcttttccactcttcatctggcaataaacactgagaagtgaattttcactttgttcagtcacaatctttacattacaaaggaaagaaaaccccagtaaccccttaaatgttcactttagaaaccagcaagttcctattgaaacaggcacaatgttatcagcagggtaatcgcatcacagacatcatgaaaccacacttcattccccttgggtttgtccccatcaccaaataaagcacacttcagatcctgggaccactctaatgaatacactcttctgacactgataaaatgtgtaatactgaattttcacattaacttcccatttagtactcataggcagtaaatcaagacattcgaaataagaagtccctcctgtcgaaaagattataatattgttattattgataccaacaaaaatgtcctctttaattcatttgtacttcaaaacaaaaatattgcttctagcctaactaactacatatctactttcactatggctttaagcttaaaactctacaaaccaaaagctacataggttagaactacaactattagaactacaagtgaaattatttttttctgtgtagtctacccttaaactttttacaggcattcatttttgtgagttttattaagaatatgtagactagggctggtgaaactgatcagtggttaagatctctggctgctcttcctgaggatccaggttcaattcccagcacccacatggcagctcacaaccatctatatgtccagttccaggggatctaacaccctcttatggcctctgaggtcaccaggcatgaacatgaaacatgtaggcaaaacacccatacaattaaaaaaagtagactaggcattagattttaaactggactctacattttagggaaagtaattctaaacatatatacattgtgcaaccaattactaacattttcagaagaaatcactcgttcaaactaaatattcccagccaactattatcccaatgactccagaggcttaatagttcaatgctagcctaagctacctaacaagatcctatctccaatgaggaacaaacaaagactatcagtactggcactgggttctagtatctggcccacagtacaaaagagaagtataaaatgaaattttacacctaaaaatagtaccaagaagtccaaaactttcaatatgcagtcagtcaaaacattcaatgtgtcagagaaagagaaaaagaagcctagagtagaccagaacagtagccaccagtggtttctaaagtgtcacatattcacttgacagatctgaacataaaatttaaattattcattacaacccatcgaacaacatttaatcaagcattaggtaatataaaaatgtagcacgttttgataaactacccaataaaccctaagcacagccttgtgaactcacctaaatacatttaatttccctcaaaaattacattaggaaagttatgtgaacagatcttcaatttttaatatccttagaaatgtccagacacagtcactttccattaaacccaaagtctcagtctcaacaaaagtaacaaattttcaaaaacaagaacaccagtttcgtatttctattaattttagtaaaggtttttgtagaatttttttccaactgcaaatgctcttaacactgtaacagtatacactgctcaacaaggtcccgaacaatttgtttctcctaagactgaattcatcaaaattaacatttccaactatccaagaagcctgaagaaatagtccactcacagcctctcccttcaaatcctagtttttcccaccaggttgtgtaggctggtatcaactcaatcttaaagaacataagatgattgttgccaactgcacacattcagtcttctctgtcaatctaggagtcaagaaggctttaggacccagaatacagcaacacagcctgtaattctccacataccctatctaccagaatgaatgaatcttttgcactgaattaaccctaagtagaccactcgggagtccctcaaacttttcactacatagcacacgcacgagtccactcgcttaccaacgggcatccaaacccgctacattactccataccccgtcactaacctgtagatccttaagggacttcccatctatttcacgcggctgcaaactagcgccgccaaccttcagccagctacctaaggcacccatcatccttcctccctgttgctccccccgcccaaaggtgccgtaaaggtgttgcagctagcagccccttccctatctgggtaccaaggacctgccatccttgctacagttgagacttcaccccttcctccttagctacagggcggctccagattccctacactccctagtaagaccctccttagtgctggtcatagacagcacttggctgcaacccgttgcaccttcaggtcctgaaggcggcgggttcctggcctccggggcgagcttcctcctcctaggtgtccctaatgtggtcccctttgctggtcataggccactgggagctcttcactttggggcaggggtgggagttaaaacctcggccccgtcggaagcccaagaagccctccccattctgcgtgcaggcgttttcatcgcaacccccacgccccggcagttcgcaggccgcgggggccacccagggccggccgattgccctctcaagaccaccggggcgtccccgctacggcctggagcccactgcggcacgccggctccacctctcgcgtcctcggaggccgcagagtgtaagcggcaccccaggacccccgcagcctcgccgcgaccctttgtgtagggtgctcgcggccgcgggctccgaggcctgggaaggccccgccccgaggcaccgaggaggcggctcgagccccgcacagccccgcccgtttcggggctgcgggagtcttaccggggagagcttgcgcggcaccagaacccagacccgagttaccccccgcgcgagtgcctcagccccgcggccgacagccccagcccggacggcttcccggagcccactgcagccagcacctccgatgccgcctcacaaaatggccgcccgcccgctcggcggctccgcgtcccaggagggggcggggggggggtgcgacgtcacccggtgggagacgcaggcgcgctgaggtttgggggtaggaaggggaagcctcggaagttgcaggtgtttgcggcgaagggggtttcttaattccggtttgtggagtttgctcccgagccaggcctgaagctagtgccccaggttctttgcagggcctttgtgcaggctgctttgaacctctgtgaaaggagcgaacagtgcctaccttgcacaactgtcttgaggttaaacggaccaaaattgtagctttgattagactctgccgagcaaaaaaagcgtggtggttttttgtttttgactattgaaaacattcggccttggggctggagagtaggctcagtgggtaagagttcgttcgtactgctcttccagaggtcttgaattcggctagcaacatcgggtggctcacaacctcctgtaactccagccccaggagatctaacgccctaccctggccgccgaggtttcctgcactcatgtgtacataccctcattcacaaacgttaataaaaatgaaataaatctaagccggacgttggtggcgcacgcctttaatcccagcactcgggaggcagaggcaggcggatctctgtgagttcaagaccagcctggtcaacagagcgagttccagaaaaggctccaaagctacagagaaaccctgtctcaaaaaaccaaagatagatagacagacagacagatagatcagcctgatctacaaagagttccagaaaagccagggctgttacacagagaaaccccccctgtctggaaaaacaacagcaaaaaaaatgttcaacctactgtggcaacccacataatcccctgtagggagtcctggtctgcaccagaccctgtctcaaaaatataggactaggtgtggtgcctcatgctcctaatcccagcatatctgaggcagaggcagtcagatctctgtaaattccaggccaccagagtctacaaagggagtgtcaggactagatagtaagattttccctagggctggggatgtagcaggcagtaccctgtgtgagtagcatgcatgaggttctagatttgcctcaggcacaaaataagcaaatgtggtggtactcacctgtaattccattatataggaggtaagacaggggaatttagagcccgctataacgggtgagagactcctgttgcaaagtctgagccggacagtagtgacacatgcctttagtcccagcactcaggaggcagaggcaagcagatcaaacctatgtgagttcgaggccagcctggtctactgagcaagttccaggacaggctccaaagctacagagaaaccctgtctcaaaaaacaaaagaaaaattaataaataatttatttttataagcattgattggtattttgcatatatgtattgttagatttttgttgaaattagaaataaaaggggagagcacaagatgagacatgttggacatattaactagtttattataggtccggcagagtagggagactaatagagaagaggaacagggttaatggctgaccgccatggctggtcgcgagaggagagcgagagagcgagagagagcgagagagcgagagagagacagagagagagagggagagagagacagagagagagagagagagagcgcacagaggagagaagagcaaaggaggagagagaagagcagagagtagagatcataaatgggcaggggtctgtcttttaaaggggtcctctgcacctgcgtgcagacttggttcccatggaaccctggctgaccagggtactgcctgttctaccaggtaacagggtcaggccagcataatgcccgaacctttcatgtctgcttgtgtgaggatgtcaaatcccctggaacaggagttacagacagttgtaaactgccacgtgagtgctgggaattgaacctgggtcttccaaaagagcactcagtgttattaaccactgaacactctctctggcccccataaaatacatcttaatattgtcttgttacagaaaaaaaaaaagaaagaaaacaacctttctcagattactatggacctagtcttcatcaatcctcatccctccacttcctgctccctaactgtaccctgtatctttttcttggggggggggggtcagaggttgcattgtcttgacacaggatctcatgtagttcaggctgacctggaactatgcagtccaggatgtccttgaatttctggtcacttttcctcaaactaccaagtgttggggttaaggcctatcccatcacatccagccttttgtatactttgtatctctttgttaaagacctgggattgaacgcaaggcttgcacaaactaaaccagtaagtactctaccactgagctacacattctcagccctgcactttaatgaaagtctctctgtcatggatctagtcttctaaatcagaaagtgaagcattaatttaccaacaaaatcggagcctaaactgagtagtggctgcacactcctttaatcccagcgctcgggaggcagaggcaggtggatctctgtgagttcgaggccagcctggtctacagagagagttccaggacagcctccaaagcaatacagagaaagcctatctgaaaaaaataaatgcccccacgggaggggggggtaactaacaaacaaactcatgaccacatgtccctgcaaccccaggcccctgccctatcttgcttaaatgtatcttgcttaaatatatggttattgctttacgttgtactttatgtaacaaccttgagtaaccatggaaacttgtaatcttgtggctctaagatttgtggtcattgcctgtaaaaactttcctcaattgttggtagatacctttcactctcacaaacatagaggtccctgacggcttgaacaataaagaaatcttcgcttttgcatctgagaatctgctccttgtggtggtctatttgaggtttcaagaacctggcataacaatttttaaagacaaggtctttccgtgaagttcactgaaggagtttaccagtttggctttttttggctggtctgcaagatgaagggatcctattatttatttcctttttcttacccagcactggggtgaaggctaagccgccacactggctttttttacttgggttctgggaactaaactcaggtcatcaagcctgtgggaaaagcccaagaaagaggactgttacaacttggcgggcatcctagtctacagagtgagacacataccatttaaaaccagaagagagttgtgtggatgtctcatcctaagcaagtaaattctgaagcaactactctcaaaagtaaaccagttccctctgtcttactacaaactattagattacattactgaagcaaggccccaaggcccattcccttgtttggccaacccctccccctgaggctaactaccaaggtcccacaataaaagtgttgaaatccagcaatcaaaagccccctttagggttggagagatggctcagaggttaagagcactgactgctcttccagaggtcctgagtcaattcccagcaaccacatggtgactcataaccatctggaatgagatctggtgccctcttctggtgtgcagatatacatggaagcagaatgttgtatacataataaacatataataaaaaaaagaacttaaaaaaaaagccccctttaaagccgggcattagtggcgaatgcctttaatcccagcactcaggaggcagaggcaggcaggtctctgtgagttcgaggccaacctagtctccagagcgagtgccaggataggctccaaagctacacagagaaaccctgtctcaaaaaaaaacaaacaagcaaaaagccccctttagcagggcggtggtggcccacgccttttatctcaacactctgtcggcaaacagatgcaggcagatctctgtgacttctagactagcctggtctacaattgctagttccaagacagcctccaaagccacagaaaaaccctgtctcagaaaaaaaaaaaaagctccctttggcccaactaattaacatgtccaattaaaattaaatatctcatcctaacatggggttccccttgtgcttttataaacctccattttcctatgagccaaatgagactgtttcctctctatccagaggcagtcctttgtcctctgggacaaatacccctccccctttccctggttcccttccccttctcccttttcctctatcttctgtctttgtcctgtatccctgcctctgtccctctatggcaaataaatctcctttggtctgagaatttggtcttgggagtcctgagcccatacttattggagtgtacacctttaattacagaaataaataagtgaaccagggccagtgacatggttgagcaggtaaaaaaacactagctatgaagccttgacctgagtcccaaaagccttcataaaagtagaactgactctccgaagctgtcctctaacctccacaagtgaaccataagtaaatacacacacacacagagatttatataaaaatttaatgtttgttttggtttttgaaacagagactgtgaggccctgactctggaattcgatttgtaaaccaggctgggtttgaacctactgagatcttcctgcctctgcctcccaagaactggtattaacagtatgcacaaccaatccagctgtttgtgttgctgttgttttgaggcagttatcaattatgtagttctggctggtttagaacttgcagtgtaaagatcagtttggcattgaaattagattgccagcctttgcctgagataacagacatatactttcatgccccatttaaaatcattaaaaataaaaagactcccctggcccttttttttgagactttttttttttctttttttgtctgcttacaggactgggcactgaactcagaacccaaaatgctctatgactgaggtatatccttaaccttataaaggcttaattttttttgttttgttttagataggtctctttttaggcaacactcttaaagaaatagaactaatagaatgaacatgtatatactaaaaggaattaattacagtggcttacagacaggcccagttagtccaacaatggctgtttccctgaaagaccaagaatccatgagacagaatgtcttttttttttttttttttttttaagacaggttttctctgtagctttagagcctatccttgaaatcactttgtagaccaggctggcctagaactcacagagattcacctgtctctgcctcccaagtgctgggactaaaggcatgcgccaccactgcccagccagaatgaatgtcttggtttgagatccaaagttacatttaagttttaataattctgcctaagagatccatgaaacaaaaatgcctctgatatgcaagccccttgcccaaggacagatagttcctaaaaggctggaggctattgtttatgggccgtaacaagccaaaagtgtcactcccctcaatgtttatttgacctatctgcaccaatgtgcttgatcacgtgcgtgtaggaggttcacaggctggaggaatgtcaggaagtatgcttgtccctgattggacctgatggaaaatgcactgaattatgggtttttccttcttaagccaatacaaactgattctgggccatttcccaggaacctgggtgtggacttgaccagaacccatctacctggccagaatttaattaaagtttgcttcaaatttggctttaaattgtggtagtggtcttattcttgatcagtaggattaacattaacagtgtcactctggtgctagagttgcaatgaagtcctggagaacttcagtctaattggaattcctaagaaaggtcctatttgctttgatttagcatagtttctttattgattctttgataatttcacattatggaccccagtaatttcccaatcctttcatcccttgcagcatctccccacaaaagaaaattttagaaaaatttaaaatcaaaacaaaccaaacacaaaagctctttgctcttccatctttcctaactttccagcacctcttcatttggtgttagtggtattgggagccatggtgttaacacacagtatactcttttgtccaatcagctttacctgcaaatgttcattgcaataagtcactggtctggtttgaagcctcaggtttctggcacaccatcatcactggaccctcaccaaaacacctcttgaatattctgctattgcccagagtcatggagatcctgtgggtaacattccccaggaccagccccttcacgagcatcagcagatcatagatgggtagatgttaggctgggccaacttcaggccctggatgggggcctgggtgctagctgagctggtccgtcctggccactggggctgtcccccactttgggcaaagggcaaacccagctctctctatgtacaagtcatggctagttctcccatgtccatggagaagggtgggaccattcttctgagtggaggggagaggcagctctctcatgaggggtaggaacagctctctatgcagtgattagctaggggcagggcaagttttcctagggccagcaaagggtagggtcagctcagcatggccctctaatttcatcaggcatggttcctatgtcccctgatcccaacccttcctccccatgataacatggaccacagacatcaacacagaccccaactgcaccaggaccatggacacagacgtggcactgggcagcagctcagacacaatgaccctgggtgacaataaaggccagtcagatcagcatggccctggtggcatcacagccctcagacaccaataagaccacaggctttggccacaggttcagtccattgccatcatgggtggaggggagagcgtggcaatgtgtgggcagacatgacactggagctgagagtgctatatctttcaggcaacaggaagtcaactgagacactgggtgatatcctgagcatagaaaacctcaaagcccaccccaacagtgacacactccttccaacaaggccataacaactccacccagcaaagcaacacttcctaatagtgcctctccctatgagattaagggggccaattacattcaaactaccacaaaagttttttttttttaattatttacatttcaaatgactgagcagctaaagacacttgctgttctaccagctacagaggatccaatgcctgtggcctctgggagcacctgtgcccacatgcacagacacaaacatactacaaagaacatgaaaaatggtaacaggatgaaatcaaacacatatacaactagcttcctttcttcttcttctttttttttttttttttgttttgtttttcgagacagggtttctctgtggctttggaggctgtcctggaactagctcttgtagaccaggctggtctcaaactcactgagatccgcctgcttctgcctcccgagtgctgggattaaaggcgtgtgccaccaccgcccggctctaccactagctttctaaaatttaaatatgtatggtaaattaaaagctttttagttttggttttgtattttggttttgtttaggccactaatatttggcaaaatttaaagaaactttctccttggcagttagtgctgagagtgtggagtgtatgctctgggcttggaacacacatttattattattttttttaaatctaaaaaaaaaatttaaagaaaatattctatcccctatcctatctttgtgagtctaaagttttatatgtaacttatcttttatcataaactaaggaaaaccataaccataactatctgtcttcaactccatcaaagaccccagaaggatataatataaactctataattgacagagacatcttgctgcctagacagtcacccaaagtttctctgtaactttggggcattcattttcagcccataagctgaagtttctggcagacgttttaatgaagtaggaaatttgaagatctcttttgtcttgtattggcaaagttgctctcttttgtgagccaggaaccctgaagaaccattttgtctcttggcaagttcagcagtcacttccctttgtaacctgcttgtccagtttggacagcgtgcttactgtcagcaggtgaggcaagggcaaactccataacgagtttcttctgcgtctatcttcctctatgatgtaactggtgttgcaggaacagttgtgtcttattgtcatgaaaaaccctaataagtcattttaagtcccgtattctgtaggtctttgaaaggttttcaagaatatgtatccatatgaaaatatatctctgtatatctagaaaacctaacaaacataagttttgactattataggcaggcggatctctgtgagttcgagactagcctggtctacaagagctagttccaggacaggctccaaagccaaagagaaaccctgtctagaaaaaaaaaaattgtgtcaataaaacaaaatccatacaaaagcaaagtactcatttctatatcatattcctttttttctttacaaagagattaactgcgatcattaactacttataaccaaccctgtttaaatgaaaacaaacatctataaacaatatttgagaatgtgggcatagttctctccaaactgcttcttgctgtttaaggtgctgtcaatcccaaggagatcctgagaaaacccagaaccatggccaaatcctggctgtggtagtctgaggctgcctggtctcagctattttggatgttggatcacctgggccactgcttcaggggatcttgcttgatcaaatcatattagtctggaaagaatccacagcttttcatcttctgtggaaacaaaagcagaacctcttttccaaagtaacacgtctttagacttaaattttgaagtcaaagcattttcaaaatatataggttggaatgtatacaacattctgcttccatgtatatctgcacaccagaagagggcaccagatctcattacgcatggctgtgagccaccatgtagttgctgggatttgaactcaggacctctggaagagcagtcagtgctcttaacttctgagccatctctccagccccaacccaaagtcttttagcagctgttattcctttctctgcaatcaaacaattcaaagacaacataataacatatagtatccaaaatctgtgtatttttcatctttatatggctttttttattacttttaaaatttttttattttatttatttatttatttattttgagacggggtttttctgtgtaattttggctatctttgaactcactgtgtagaccaggctggccttaaaatcatagagattcacctgcctctgcctctgaagtgctgggattaaaggtataccacacccagctactctattccttttttaaggactttctctatcctttttcttttctatcctaagcctacctatattttttataacaaatatttatttaaaagaaaagataacaggcaagatttgactcaaggcatatagtttgttgactactgaaactgaaaattaaattctaaatttagaaattattaattagaaatcactgtaaactgtttatcactagaacaaaattagtgcccaggaatattcttagtagaaaatgtgcaagacagatatgccacaagttatattactgtatccaatagtgacatgggacacataataattgaattaaaacctgaggacttagatgggaagtttacatttaatgattccagttctcttcagtgcatctaagttgaagaaattcaaactgtattttaatagtaaataatctaatgtttaacagataaaaaataaacacaggagagcaaatagtctctactattctcccaaatggagagagactgaacctagaggcagagtgtaaggttgtttgctttgtttcatttatttttctgttttttggctctaaataactgaaattctgcctgaagtataaggaaactcaaactcatactttataagtataaatttggagacaagttgaagtcatttttgatttaattcagacttttcaacccaattctcagttttcttacttaaggatggagttttcaattggaatgatttatcattgcagagaacttctggcaaggcttggggatgttgctgattgttagagctgggtattgagagagggcatggtgtgcagcatagcttctggctctgtggagtgaacagaggccagggataatatataaacatactataacacatgagacaatcctcagtagcaaagagctctctgcctccaagtgcgatgcgaaccctgtcctatgatcacttttgagtagtatttattcagaagtagtgtccttcagaggtaaaaggaactttctttcctacctatatttttaaatgcactgtaaaccctttagaagtttttcttcatctgaatcagtctttattgtatatctctgtctttttctgacagtgagtctttattctgctaaactgcgtggctaggattaaagctgcagctttggtagctggctctgctccattctttggcttcctgggaatctatcttcatcgcagaggtctggcgggagtcatttttattgccacaactttgcagagtttctccgtccatgccaccaccaagaagcatgtcaccggctgcttgtaaacaccatttaggtgtttggtagcaaggcctcattagccctgcagtttttgcggctaatgctgagtcaggaagtctctcttgaagcagctaagcctctgcttatctctagcaaacagagcccaccagagaaaatgctgctaccgagaagccgtgtttgactctgttcttttgtttttagaattcctttttaagctttgtcaggttttacgtgggaattattgccaaatgtttgggtgccacataattccagcactcgggaggcggaggcaggaagatgggatctctgtgacttcaaggccagcctggtctaaagagcaagttccaggacaggttccaaagccacagagaacaaagctacagagaaaccccatctcaaaaaacaaaacaaaaccccaaacaaaaaaagatttttccactggaactggatttacagatggttatgaactgccatgtgggtgctgggactgaacctgggtcctctacaagaacagccaagtgctcttaactgctgagttatctcttcagccgctattctaacatacatatatttcaacacacacacacacacacacacaaaaaaaaaacaaaaaaacaaaaaaacaaaaccacacacagagtttttgtttgtttttcaagacacggtctctctgtgtaacagccctatctgtcctggaactagctttgtataccaggatggtcttgaacttacaatgatttccctgcttttgcctcccaagcactggaattaaaggtgtgtaagtaacaccactgccacttggcccctattctatcatattatattccctcatttttttagggctaataaacatctactcccgagttcagacacacagagagatgatctaccctagttgcactggcattctttgggttttctatttcaggctgtttctgctccttcttacctagctaagccatcactccctctctagggtgttttgcttaaatatgaccttgtggtgatttgaataggaatggcccccatagactcatgtgtttgaataattggccacagggagtagcactattaggaggcatggccttgttggagtacgtatgtctctaggggtgcactttaagatctcagaaactcaagccaaacccaatgcagacttcactttgttttcagctgatagggatgtagagctctcagctccttcactagcaccatgtctgtctacccaccaccatgctttctgccataagaatggactaaacatctgaacagtaatccagccccagttaaatgtttccttttgtaagacttgcggtcatgtttcttcacagcaatagaatccccaaagaacttccccagaacacctattgccacaattctccctactagttcctcaaaatagtttattatttatttatttaggtttttcaagacagggtttctctgtgtaacagctctagctctcctggaacttgctctgtagaccacgaggttggcctcaaactcacagagatcctcctgcctctactgcttcctaagtgctgggattaaaggtgggtgacactaatgcctgccaaaatactcattttttaataacactgccacatctattacagtctttattcatttctgattttctatccctcttttagtatgaaagctcacagagggcagtgtgttttctggtcctattaaccagtgtgtccctacacccagaataaaatgtgtgtcctggcaatcctttaaaatgttggatgaaaagatatgcaagtgggttgagtcatctgtgggaggcaggtgggagttctcaagtgcagatcttgttcctcagcctctcaagaactcacagaataagaagggaaatgggaatttatttctccaatcttcaaattaacaaattttaaggaaataaaatgattagagtaatggggggaatcatatggatatttctacttccattaaatcaaaagaaaggaaggaagatgagctggtcggtggtggcacacacttttagtcccagcacctgggaggcagaggcaggcagaaatctgtgagttcgaggccagactgttcacagagttctaggacaccagggctatacagagaaactctgtgtcaaaaaacaaacaagaaaataaaaaggaaggagatgagaacacaaaggaaataagcctttaataaaacttgctgttttggctgcagttgatatatccagagacatcttttgaagccacaaaaaaaggttaaaataaggtttgttgatgctagttgctgatggtgccagtccagctgagcagcgattggtgatccaaatgttcacatggagaaacagtctttgaacctagagccgtcttccagttcttccacctccccaagggtcggtaagcctagtggcagagaggcagcagtgcctctaggcgcttagcaaagaatgtccacacactaaatagagaagagcccctgaggaggaacagggaacgtctccctacaaaggctgaggctaagaaggatgcttccttgaatttctcaattaacagcgttctttggtgaaatcaactgggctatgccagctctggttgaccatggaccacccagcaggtaacaaggttcctggctgtacatgggtcagtgaggcaggaagggccaggtcagcacaaagtcacaggccggctcttctaatgttgggtccacttgatgctcttgaggtcgatgccatcctgcaccatctcccagaggggactgccaaagagaagaggcactgataagaaacagcagccaacactggtgctcaggccctgagccatgatttgcctcctgtccttgctgctcctctgcctttgacctggtgaaccccaatacaggagatgcacaagccttttccagcctcagacctgagcactctcttatacaggagatgctactgagaagacggaccatatccttaaaccagacttacttccagggtgatggcaacaatgaccattttgtttgtgtgcttgtgccactgaagagtaaaccctcttctgcactacagccctatacccaactattgaattctgtgccttctgttccccggttaattttcttcaacattactgaatcccagactttgtttttgtttctgagaaaaggtctcattcacaatcttcctgccgaagcctgagggctgtgacttcagacatatgcaagattcctggttttggttttgttccttcttggcaagcactctgccactgagcttcccaccccagccttagcttgctttttagggttcagtggactttattgattcaacaataaatggttaaggaaaacgcgttacttatcactctcgaggcgtcatctgcagatgtgagaaccacccttcgaaagccttaccttgctttttataggactaggatcaaacccaggacctttattgatgttagacaagcaatctctatgctatatacaaaaacccaacttttgggggctggagaggtggctcagaggttaagagctctggctgttcttccagaggtcctgagttcaattcccagctaccacattgtggctcacagccatctgtaatgagatctggtgccctcttttggtgtgcagatatacatggaagcagaatgttgcatacataataaataaataaaatcttaaaagaaaacattttttaaaaaatgaacaacaacaacaacaacaaaaaacccctaacttttaaagcattctaggctgggtggtagtgttgtacacccttaatcccagcacttacaaggcagagggagtcggatctctatgagtttgagactagcctggtctacagagttccaggacagccagggttacataaagaaactctatctcaaaaaaaaaacaaaaaacaaaaaaaaaaaaaaaaaaaaacaaaacaaagaatctgaacaataggaagccaaagaggtccaatttcttcctttgtggagcctttagaaacctgcaaacacaggtttctgtgaatacagagcccaaggacaggaaaggaggcagctgtgcagcttcttccacagcgtccccggcagcagtgtatacctcatttcccggaggcgcttcacgtgatggatgcatttctccacagtgtagtccacttcctcttctgtagtgaagcggccgatgccaaacctgagagaacacacaagagctctacactaggcccagggttggcttggttttcttttttaggcagtgctcactgagaacctactaaacaaaagacaagaaagatgggggtggggtggggagggttgctcactcctttaatcccagcacttgggaggcagaggcaggnnnnnnnnnnnnnnagagagagagagagagagagagagagagagagagagagagagagagagagatctgggggtacaggggactcggttcaggggtagagtgcctgcctgaaatccagggttcattcctgactgcataagaaggcatggtgccgcacacctgtgagtccagcatttaggaggtagaggcagagcaatcccgggctacatgtgagttggaagccaactgggatacatgaaagctattagctcaaaggaagaggaaaagagcgcaggctgtctttcttagtaaagcttcttagaacatagctgtggacccgaatccactgagaagtctcctacagctactctgaatatgacactcagacatcttcatcttcaccaagactcaaggaggagaccgggacatagctcagtaggaggtgtgcttgcctatttcaaaaaatgcataaaccaggcatggtggtcatacacttataatctcagtactctggagctggagataggaggacagacttcaaggccagcctgggtacttgacaagaccttatcttaacaaacaaggaacacacacacaccaggtgaactcaactgacctgatagaagagtgtgctaaatcctcatcagtgccaattgctctgaggacgtaagagggctccagtgatgctgaagtgcaggcactaaggatggagacatgaacctttagcccataggacacacccagagccattactcccagggccctggaatcataccatagggaccaaagatacatagcctggaaatgtcatggggcctggtgatgccctgtacatcctgggacgtaaacccagtccctctggtccctagagtagataatgttcttgaggaaggacactgtcaaggtgtgaaccagcagttagatccatgcactttatctgaccaaagagccagagaaccttctgtatctggggcagcaggcacaatgtatgaccctgaaggacagataaaccctaggcggcttacaaccaaactaattgtttaactctgtaaaagacacatacatcttcatccaggcataatggtgcacaagcctttaatcccagcactcaggaggcagaggcaggaggatctatgtgaggttgaggacagcctggtctatacagagagtcttaggatagccagggctacatagtccaattctgtctccaaataaaagacaaaagaagatagatatatcttctaggtcctaaagtcaccaatttctgtcaaagacagagacctgctagctatgtgaccatcagcctatggccgccagctaaaaagtgaccttaccagcatcaagagcttctccctaatccagccaggaagctcagtgacctgtaggttactgaacaggaaagctaactggtgctatcacagtgcttgtctacctggtccaactcaccttcctgaggacaaggcaacatccttgagtgccatcagcagactctccccctccacatatgcaaaggagaggttgatacaccctgaagaagagaaaacatgatgacagccctctgggtctcagactctgccagaatggagccgagagctggagacagagctaaggggtagacaatttgcctagcgtgaaagaggcaagtacagacaaacaaacaaacaaactttagctaaaaaaatatttaaaaaacaaaaacagaatggtggggctgcagagggggcaccaggatggctcagcacgtaaagcaagcacttgctacacaagcctgatgacctaagttgtatctctctggaacccacaaaagattggacgcagaaaactgactccacaaaattgtcctctgacctccacaagtgcactgtggcaggcatccccatgcccacataataaatacaatttaaaaaagaacagaattcagattggaagggcgcgtccataccagggtagtgctgtttggggtccccgttcatcaccacatctggaaggctgttcattatcttctgtatcagccgctctgctaacttggagatccgcttatggtcatactaaggagcaggaagggagagctcagtgcagtaaccaccagacagctcagcgacagagagttccagaagccctctctacccaggagtgggtgtgtgccacacaggcccttctattgtcttgctatgtgtggagatcacaggggctccagcactgtctggtgtgtaagaggtgctcagtagctgaacacacggttctaacaacccggggaaaatgaactgggaaccacgaacaggacacgttttgaatcatctcctccagaacaagggggcggcaggaccttgacagagcaggtttttatttagctgtgggcacatgtgcacacatttacttctgagggattgaaatcaaggccttgcatgtcccaggcaagtactttcctactgacccagccctttactttttattttgagccagggtcttgctatgtagtccaggctagccttgaactgaaaattcttctgtctcgggcccccaggcagctaggataccagcattgactgccacacctggctcaaagacaggatttccttccagcagagatgagagtctgctgagctgttactaaatgggagaccttgaaccgctagtgggacggacgttctgaggggagctgcggctctctccagtacccacctccatctcttgctgtgccacctcacaagctgctcccagccccaccaccaagggtgtgggcaccgtcccagaccgcataccccgctcctgcccgcctccgctctgtagggcctccacacggacccggggcctacgccggatatagatagcaccaaccccttggggaaaaaagttgttagaaaaaaaaaataagagagagagagaaacaccaatgaaacaaactggggaaccaacagaggaccaaaccgggccgcctgaacgtgagtgtcagctaggagcactgggcagtctatgaggcctctggcagtggcaccaggatgtatccctagtgcacgaacggacttcaggggtccatttcccatggtgggacactctctttgcctagatacacgggagagggcccaggccctgccccaaatgacttgacagattttgatgacccccgcttcatggaaggccttaccctcccttgggagtagatggggggatggnnnnnnnnnnnnnnnnnnnnnnnnnnnnnnnnnnnnntggggggggggggggggcatgggaggatgggtgggagagggaactgggattgatatgtaaaataagagtgtttctaatttacataaaatttatttaaaaaagaaattaaaatatttcaaattttatagttaaccttttctaaataaaaaaaaaattaaaggaaaagaagaaatgtaaaagcataatttttagcaaaagtattcaatgtaaattatgttaccacaggaataattaccaaaattatttcaagcagctccctatcatacaacgtagacttctttttaagattaattttaaaaaattttatgagctgggtggtggtggtgcatgcctttaatcccagcatttgggaagcagaggcaggtggatctctgtgattacaaggccagcctgtaacatgaatagtgaataataaaaacccagagacagatattggatttcaagctgaaagatcagagaagcaaagcagccagccactagagagttcttacctctaccactccaccaaggctggagcgatcctgtcctcagagtgactgcagactgcaatactctctaccaaaacaaccccagactgcctagactgcagactgaatacagaatgagaccctgagctcctaccttatattcctctctagtgctgggattaaatgtgagggctctgtttctcttttagacttagtcactctcatgtagcccaggatgtcaagttccagaggacctgacacccacggcaaagcaccaatgcatataaaataaaaattaatacattaaaaaaataaagttgaaggagaagaagatgatgatgataacaatgacaacccactaggggctagagatggatcaatggtgttgctcttccagaggagacccaggttcagtctctaacacccacataacagctcacacagttataactccagttccaggagagtcagtgccatctgctggtctttatggacattgtgctcacacaacacacacatgaattcaagcaaaacactcacacatataaaaataaatctttaaaaaatcaaataacttaggtgataatcattggaggaatttaaataagtcatgatatgttaatataatgaaacaccaagcagatagaaaagcctgactttgtttgtttttcgagacagggtttctctgtagctttggaacctgtcctggaactcactctgtaggctggcctcaactcaagattgacattcttgggctggagagatggctcagaggttaagagcaccgactgctcttccagaggtcctgagttcaattcccagcaaccacatggtggctcacaaccatccgttatgagatctggtgccctcttctggtgtgcagatatacatggaagcagaatgttgtgtacataataaataaataaaatcttaaaaaaaaaaaaaaagattgacattcttgggctggagagatggctcagcggttaagagaattgactgttcttccagaggtcctgagttcaattcccaccaatcacatggtggctcacaaccaacttgaatgagatctggtgctttctgctagcacacaggcagaagattgtatactaaacaaataaaattcttctaaaaactctaaaatacattgttagtaaactggtgaggtcaggcttgtggcacatgcccataatactagcactagggaggcagcatcaaccttagataaagtaaaacccctgatgaaaaagaaaggaaagaaaggaagatctcaacaactctgtactacccctttccttttatttcagcttcctttctagactctcaagtactctaaggtgacctaaaactcaatatgtaatcaaaaataaactttttcactggatggtggtggctcacacttttagtttcagcactcaggagccagagttcaaggtagttctaggatggctaggggcactcagagaaaccccgtctcaaaaaaaaaaaaaaaaaaagggtctaataatatagaactgcctaccctggaactcactatgttcactatggagcccagactggccttgaactcacagagatctaattgtatacaggactttggaattaaaggaatatactaccatgtctgacattttattttacttttaagatggtttgtaggtgaaaaagcaaatgagaacacacataatttaggtaaaaaggggtggaaggaaagtatggctgtcctcataaataaaaggaactgtaaaaagggcgacacagcagacatgtctatgaccccatcactcaggagactgaggaaggaggatgcaaactcaaaggcaggtgggactaaatcacaagaccctgatgaggagtgaatagggtcaagaagagatcctactcaagtcacattttagagtacaagttggcatctgcaagaacagctcatagaactgttaattataacctgtgggaacctttggtagccagcatggtggggcagttagtattatcagcctatctcatgaaatctgttctgtttttacttactgatacctagtgaaacctgaattaacagaaccctgttttcctaagccaaattaacatccgtatcccctttaaggacatgtggagggatcaaagaagaatgcctgctgtgtacacggcacatatgaagaggcaagagttttggctactgttgaacgaaacttgcatattccaggccactctgaaggtacaaccttcctgaaagcaatgtgatgagcatctgtcaaagggtttgctgagaagttcgaagaagaggcaggggctggtacctttaggaccatagagtttgtgaccgctgatgctcatcagatcaattttcatatcattgacatcaagtgggattttcccaacagcttgggctgcatcagtatggaaatagacctttctggaactgcaaatctgccctgagggatgacagagaagaagacccatagcacagtaaaagtaagctgccagcagccctgcaaggcaccacggatgacataagcaactgatatataagtcctcccctactctgggccttcccaccttcatgtcccctcccccacccactccctcccaactcccagcctctcagctattcctctaaagatcaagggcaaaacacaaaaccacaaacacacatgatgttttgatgcccaagattctgtataccagctcatttaccttggggctatagtatcaccttttaaattcttttttatttaaaagaagcaaagattaattggtatttttgctaatttgcatacaggttacaaggtgaactctaaatggggataaagaacattctaaatggaaaaagaatagatgcccttatcttactgtgttgtcatttggggcaaaaaaaaaaaaaaaaaatgaaagaaaaaaaaagggcattccaccctccattctaaaaactcaaatagtagccacaccacctagaatgtggtcagcaaggcacatagttcttttccttggacctcttggctactgtgttaaaactgtcagtacctgatcccttatatggaccccagggctggtaagggtcagggataacctaatatactcacctatttctgcaataggctgctttacaccaatctcattgttcacagtcataactgatactaggctggtgtctggctggatggcagcctctagttcctaagaatgtaggagtaaggagtacatgtgatgccaagagaactatataaataagaatgtagacaacctttagcctagaaaagtgacctttcactataactccatctgaacacttttttttttttttttttttttggtttttcaagacagggtttctctgtggctttggaggctgtcctggaactagctcttgtagaccaggctggtctcaaactcagagatccacctgcctctgcctcccaagtgctgggattaaaggcgtgcgccaccaatgtccggctatgaacacttaaatcttaataacagggggtttgggatgtagctcagtggttacctagcatgtttaatccctagtaacaccagataaaaatacacagtaacacacaaggcactggagacatggctcagcaattaagagcaccacctgctgtaccagaggacccatgctcaattcctagcacaccatagaggaacagaactgactctaactccagttccaggggattggacacattcttctggcctctacaggcaccaggcacacatgtggtacacagacatgcatgcagagcaaacacccatacacaaaaaatagaagttaatcaggcgttggtagtgcatacatttaatcccatcactctggaggcagaggcaggtggatctctgtgagtttgaggccagctggtctacagagcaagttccaggacaggctccaacacaatacagagaaaccctgtctcgaaaaacaaaacaaaacaaaacaaaaacaaaaacaaaaagaagaagttaaaaaaggatgggctgaagaaatggccagggggtttaatagcacgtgttgctgttgtagatgacataagttcaattcttagcacccacacagtggctcactaccgtctgtaacacccaggcactcataaaacaaatctaaaaaaagaaaagagaatggctagttgagtaggtattgtaccctatgactataataccaactctcaataggatgaggcaagaggatcaggagttcaaagtcattcatggctacagagccacttgagctagcctgagattcacaagacactgtctcaaagacaaaaaaaaaagaaaaaagaaagaaagaaaagaagaaaaagacttaaagcttacacaagagcctaactagaccaattaaacaaatcctgatttcaagctgccacagagatacagaaataagagcagtatggtcatggcatgaggacagacgtgaactaggacagaaatatatattcaagtcttttatttgtagacaggatctcactctgcagtccaggctagctccacactctggtgatcctcttgtctgagcctccagagggctgagtttaagggtctggtctatacttgcgtgtttgtttttacagttctggggttcaagtctacagccttgtgcatgctatgcaggaattctactgctgagacacacctccaaccacccggctccctttatagctcgtaagaaacattagtgcagggaaggatgaggcagagctcttctgtggcgtggatatctgacatcctacactcatgtccagcagctctcctacaaaccaggatcaccaaaaaagctaagaggcaagtcttccacagagaagatcagtgcacacatagagagcatcatctccctctctgctcaatgctccactctcaccattagctcaacctttaggctacacccacggctggagagacaggatgaagccaggccccgcccatttttgtcagtccagcctagcataggactcctacctttaagtcaatgatcccactcttctgcactgggaggtaagtgactcgaaagccctcagcctccagtgagcggcaggaatccagcacacatttgtgttcagtctgagtggtgaccacgtgctttttccgtgacttgtagaacctggccactccctaaaaattgatgataataggaaaaaagtataacagaggtagcaatgacatgaatcctatttataaacagttttcctaaggactgaatccagagcctcgagcatgctaaagatattctatgtcactgaccaagttcccattcttgtatgtgatactgtcaacatcagaagaaattataaaaataggctaggaaaaactgaaataactagaatctcactatgtagctgtgaaattcacagagatgtgcctgcctctgtgttccaagtgctgggattaaggctctgcaccatcacacccagttttgctgaactatttataatagctaagaaatggaactcaacagaaaatgcccataaagagaatgtggtacatatacaatagcatttaatttagatgtaataaaaaattaaatagtgacatctacagaaaaatgaatgaaatcacaaatcatatgttaagcaatataagtcagacagaaacaaattctgagctgccaacaggttcagcaggtaagggcagttgccacaaggcttactacctagagccccaattgtggaacctcaacatgtgtgttgtggcacaggcatgcacaaacataaattgattaaatgatctaaaaaagacatgtatcaccgggcgttggtggtgcacacctttaatcccagcactcgggaggcagaagcagacggatctctgtgagttcgaggccagcctggtctacagaacgaattccaggacaacctacaaagcaatacagagaagaaaccctgtctcaaaaaaaaaaacaaaaaaacaaaaaaacaaaacaaaacaaaacaaacaacccccccaaaaaaaccgaaaacaaaaaaagacaagtattatatcctctcttaagtggaatatagatgtgttatagatgtgtgcatatgtgtaaatatagccatatgtgtgtgtttctaagtcataaaggtagaaaagggaccatgagaaaggaaagagatctttgtatgtatgtatctgtctgtatgcatgatgtgtgtctgtccatggacatgaaggcaagaaaggatgtttggaggtcagaggacagacaacctctagtatcagtcctcaccttctaccttatttgaggcaaggcctccttgctgtttgctgctgacctgcaagcctgtgcagggtctcttgtctcttctgcctagcagttacagacacacacactgttatgcctgacttcacctgtgctccgaggatttgaactcaggtcctcacacttgcacagctggaaaggtagtcatgatggagagggtacagacacagtggcgtgaaagggggaggggacctactgagggaggacaagggccagcaaggatggggcagggtaaaaacgaaatgtgtgcatgaaaagccataataaaatccattactttgtattctgattttaaaaattaatttaaaaaatttaaatcttggggctggggagattgctgtccttgcaaaggacccttgttcagtttccaacaccttcatggcagctcacaaccatctttaactccagttccaggagatccaacactttcccttggcttccataggtaccaagcacacatgctatgcatgcacactcgtatacatgaaaaataaaaataggggccagaagcctttaatgccagcactcaagaggcagaggaggtggatctcttgagttcaaagccagcctggtctacagagtgagatactacagaggctacacaaagaaatccaatctcaaaaaaaaaaaaaaaaaaaaaaaaggcagaggcatgaggatctctgtgagtttgaggccagcctggtctccagagtgagtgccaggataggctccaaagctacacagagataccctgtctccaaaaacaaaaaacacaacaacaacaacaacaacaacaaaacccaaaaaagcaaaacaacaacataaaaaactaaaccaaacaaaaaaacaaacaaacaaaaagggggttgggagttaggttggagagatacttaaaagttaagagaattggctcctcttccagagaacccaggttcagttccaaacacccacatggcagctctgtaactcctgtcccaagggatctaacaccctcttttgacctccacaggcactacatacatgtggtacacagacatacatgcaggcataaacacccatagacataaaacaaaaatatatttaaaaaggacaaatagggggttagaatggaggcctggtggctaaaagcacttgttggtcttgcagagagttcccagaatccacatggcagctcacagctatctgaaactcaaatcccagagggccagacacacttctgaccagctttagacagcaagcatgcatgtaagaaaaatctgagccggacgttggtggcgcacgcctttaatcccagcactcaagaagcagaggcaggcggatctctgtgagttcaagaccagcctggtctactgagtttcaggacagcctccaaaagctacagtgaaaccctgtcttgaaccccccctcccaaaaaaaaggaaaaataaaaatgctgaaacacataaaactaacaaaaattttaatttccttttatattttttaaataatttatttatttgtattttatatacaatggtgttttgcccacatattggagttgtcagattcactggaactagagttacagacagctgtgagctgccatgtgggtgctgggaactgaacccaggttctctggaagaacagccagtgcacttaaccactgagccatctctccagctcaattttcctttattttattttttggttttctttctttctttttttcttttccccacaagacagggtttctctgtggctttggaggctgtcctggaactagctcttgtagacaggctggtctcaaacccacagatatccccctgcctctgcctcccaagtgctgggactaaaggcatgtgccaccaccacttggcagttttcttttgtctttgagacatagtttctctgtgtagtcctggctgtcctggaacagtcctggctgtcctggaacatacactatagaccaagctggactcaaactcagagatccacctgcctctgcctcctgagtgctggcattaaaggcgtgtgccactaccaacaggctccactttttttttttttctggtttttcgagatagggtttctctgtgtagctttggagtctgtcctcgaactcacagagatctgcctgcctctctccagagtgctggggttaaagacttgcactaccaccaccaggcttaatttttttttttaaatgtgcgttggtattctgccttgggtgtcagatcccctgaaactggagttacagacagttgttagttgccatatgggtgctgggaattaaacttggatcctctgaaagagcagtctctccagtcccaactcccaattttaagtagataaatccttaaaaagagataagttaatcttatcaggtgcacaaatgatttttcaaaaaccaaaaacttttaaatgacaaaatgagggctggagagatggatcagtggtaaaaggagtatacagctcttgtagaagaatcatgaccggtccacagtataaacactgaatggctcacaattatctataattcactccagagggatttaatgcctctggcttctgagaacactgcagtcacatgaacatacccccacacagatacacacaaaactaaaataaagtttttttcatcttaaaaaagcctggtgcagtggggtatgtctttaatcctagcattcagaaggaagaagcaggcagatcactaggagtctgaggccagcctggccaaaagagtaagttctgggccagccagagctacacagtgagaccaggtctcaaaagagaaaaaaaaggcaggatatcagaatattaacttatcagtggtacagcacgactttagtaagcttgaaagttgaaatgcccatcaccaaaaaataaataagaaaaaaatagacaaatagttgactagatctaagtaaaatgtgattgtgttgtatgaattatcagcatgactattaagagtgggacacttgcacaaagtatctgcttggcccaaatatagaaagactgatacagacctagaccgagtcaatggcacagggggtaccaaagcaacaattactgaaaaggcagaggaactctgtaaacagatccaatcagaaagcaaagggagagcccataggaaagtaagagtgaactgatccctgatggggaatgtactgtgtatgtttatcttattgattgttaaataaaatactgtttagccaatgagacaccaagttagacgggactaggagtcaaagaggattctgggaaatgtagtagagaagtggtgatccagcaggcagtgacatagcaaggagactcatatttaaagaaggagaaacaggaagggtccctcttttccccttgcccctccagcagcacaaggtgatccaccggcaaggagggatgccaatacggcgtccgataagataagtcttataaaatatatagatttatgatagttaagactgagctaacagatgaggaatcctagtcattggccaagcagcatttgaacctaatacaagtttctgtgtattcatttgggcctaactcgggcgggcggctggtgtaaagctcacacgtggcagtggggctcaggcggcttttggtagaaagatttatagtaacagatcccagttagttttttgtcaacacgaaacaagctaagatcatctgagaatggctacctagctggaaaaaaatgcctccatcagactactgcctgtagtcaaccagtaaaggtactgacctgattaataattttttttttctttttttttagtttttcgaggcagggtttctctgtgtagttttggagcctatcctggcactcgctctggagaccaggctggccttgaactcacagagatctgcctgtctctgcctcccgagtgccgggactaaagacgtgcgccaccaacacctggccctgattaaagattaatgtgcaggagctaatgcaatatgggtggcactacccctgggcaggtggttctgggtggtataaggaaacatgctgagcaagccactgggaggaagcagcccttctccatggaatctacttcggttccttccctaagctctttccctcacttcccttcatcaagagccagtgctcttaacctctgagccatctctccagccaccacatattttttcttttaaggcataagaaagaaatagggaggtgtgggaatctgaggaaaaaaatatctgagtccaaatgataaaggagctctaatctctaaacccaaaaagcccagagatagttctggctcccttctgtttccttctgtccctcatcttcccacatgctcctcactctcctaaagaagtggtccaccacacagtgtcctcaccccattctcttaccttaattgctatgttgttggattcagtagctccactggtgaaaatgatttctcgaggatcagctccaatcagagatgctacttgctgtaagccaagagccaaagatacatagcatcagttccctggcaggagtagggctgcagacatagctaggccagagtttcatggcaagagaaactccactgcattctacccactgcctaccaagacactctgtgcatactaggtctggcttgagataaaaaaaggaactgattattaaagtttaaatgttctattctttctccattctaggacagtctaataagaatgtcaaatgtggccgggcggtggtggtgcacgcctttaatcccagcactctggaggcagaggcaggccgatctctgtgagtttgaggccagcctggtctacaaaagccagttccaggacagcctccaaagccacagggaaaccctatcttgaaaaaaaaaaaaaatgtcaaatggagctatggctcagaggttaagagcactggctactcttccagaggtcctgagttcaactcccaggaaacaaatgatggctcacaaccatctgttacgagatctggtgccctctttgggtctgcaaggacacatgcagacagaacactgtatacataataaataaatctttttaaaaaagtaaaaatgtcattcagttgatagagtgcttgcctcatatttatgaagccctgcatttgattcccagcactgcataaaccaggtatggtggtgcaaacctcaggaagccaaggtaagacagctgccatgagttcgaggccagcctgggatacagtaagttccaagttatcttaggctagaatgtgaaactggtctcaaacaactaacgtgcggagccagtgagatggagcagtggcatagacactactaacaggccaggtttcacttcctgagatccacctggtaaggtgaaagtctgctccaagttgtcctctgatctccatactgcatagtttggtacatacatatatacatacatgcactcaaaccaaccacacacatacacagatgttcacgcacacatatttgcaatttaaaaaattattctttgctgggcagtggtggcacacgcctttaatcccagcaggcaggaagcagagacaggtgaatctctgagttcgaggccagcctggtctacagagtaagttctagggcagccagggctgttacacaaagaaacactgtcataaaaaaacaaaatcaacaaaaaaattctaacaaaatgtcaagcaagaaactggaaaaatggctcagtgttaggagcactggctcttcttgctgaggacccagttttagttcctagcacccgcatggtggttgacaaccatcctaaacttccaggcacatacatggtacacacacacacacacacacacacacacacacacacacacacacacgcactcaggcaaacactcatacacacaaaagtaaaaaaattttaaaaaacatgggtatctacatctcatcaatacatctatgcacaaatgcaaaaataaatattcttaatgataaattttgtttttaaataattttttaacatttatttttggttgggtaacattcattccacagcatgtggatttttgggggattaaacttaagttgtcaggttagaaatgcatttttaaaatatatttaccgaactctttctatgcacttcttgagcaatgtgtaagtgttagcctttaccaaaccagcactgtgtcatttaacttacccaatccccttatagagcatgaactatttcactttcaacttgataggtgaggattttaaggcttagagaaatgagatgattttcccaaggtactttacctagtgaatatgtgaagtaattaaacacctgcagtccaactccaaaactactctctgaatctcttctagaaataccaccatttcctaagaaagaaatgcctcccgcaggccaccaaacttgacttgcaacttcacagagttctttgtgctaacctggcgagcatgttccatggctgcttcactctcccagccatatgcatgagtccgagaatgagggttcccatagtagttcacaaggtatgggagcatggcatccagaaccctgggatcctgtacacaagagaacagatcagtctctctgagtctataatcaactcagaacctgctgcagccactgcaactgcccaccttgctcagtgcccacctcttcacatactaatcaaagattgacctgatataccatactcccacttcgaaaacatttttttggggggagaggggttgaaacagggcttctctgtggctttggaggttgtcctggaacttgctcttgcagaccaggctggcctcaaactcagagttccgcctgctcccaagtgctggtattagtttatgctagggctggagagatggctcagcagttaagaacactgactgttcttccagaggtcctgggttcaattcccagcaaacacatggtggctcacaaccatctataatgagatctggtgccctcttctgacctgcagacatactacgggcaggcagatcattgtaataaacagacaaatctttaaaagaaaaaaggaagtttatgctaccatactggcaagtcacagctctttgtaaggcatttcttggcaagaggactgcatttctgctctcccctaggaaaaacaatgggaacacctgtagaaacagttggaacaggcctgtgtgggatgggaatctagatggtagggcactggcccagcatgtacaaagcctttagttggattaccagcacttcacaaagccaggcatggtggtatacagttctgatcccacacaactctaaagtattggggaggtggagtcagaaagattgggatcagaagtttaagatcttcaactatagagtaaatttgagggtatctgaggttagaggccttgtcttaaaaaaaaatgtaaaaggggttaggatggagagatggttcagtagttaaagacactggttgctcttccataggacccggatttgattcccagaacccatatcaggcaaattaaattgccctgtaactacagttccagggaatctgacaccctcttatggactccatggactcttggtgacatgtagggcacatatacacatgaaagcagaacgcccacacacacgtaattaataaaataactttttaaaaaaggacaagattgtattgctagaagaatgattaaaatgtcaggctgttttgttttggtggggccggtggattttagagacaggggctctttgtataactggctggcctggaaagcacttgcactgtagtcaaggctggccttcagagatctgtctgcctctccctcctgagcaatgggattaaaaacatgtaccaccacacccaggaggactacaagtttgaggtcagactgaactacataagactctatctttcaataaacaagtaaaagaaaatttaaaccaggttggccttcaagagactctctcttaaaacataaagtagcctggcagtggtccatccctttaatcccagcactcaggaggcagagacaggtggaactctgtctgacctagtctacagagcaagttcccagcaattcagagaaaccctgtctcgaaaaaccaaaaagaacagtcttaggttctagagagatagctgagtggttaagagtaaaggttgctctttcagaggaccgaggttcaatttctagcaaccacatggcagtttacaagggcctatagagttcccgtttgaggggttccactctctcatggcctctacaggcacaacacgtatgtgctgcgtgcagacaaacatttaggtaaacacttacttgtaaggtaaaaagaaataaacagggtcttatttattcctagttagtcaaagatgaccttaagattccgatattcctgcgtctacctctcaaaagctggaattacaggaattgagttttatgtggtgctggggattgaacccaagactctgcattccagccaagtactctaccaactgagccacatatccagctcttagtaactgtttttatttcatgcttaccatgtgctggactgctgtctttcatttcatttaacacttgaccaaatcctcacacatttactatatggtagttaattccggagctaattccagagcctatgtatttgtctgttttctttatttattttttatttttacacaggtttgaagctccctatgtggcccaggctggccttgagctcactcaaactctccatgctacaatgtccagctccaaggcctgagcatttacaattaactacaatacctgttcgaaagtgatttgaccaagatcaatagctaaaaactagtaaagccttttctagcaaactaaaatctaagcctcctgatgcctgactcgcttttctagcacatttaatggttctgaattctccagaaatctagccttctggtaaaatttgttctaaccctcaaagagcctgggggaaggttccctttagtccttaccagaggagttgtagcctgcacatccatatagagaggtcgcagcactgtctctgagggaacagccgagtggatagcatgatctacgactgacaacagagtggagtggcaaagtgagaaatgacgcaaccgtggatgccaggtgcacaagacaacagattgccaaagccgcttcgaggtaaattaaggaaggttgaggtcgagtgtcaaaggaaaagaaaacaacgggcggtaaaagatattgaggaaaataatagacgcggggttctttgaagggacgctggcggcaaaagggagcaatctttaaactatccagcagagtggatggctctaaaaagcaaaaacctttataagaacattgaaaagcacagggtccttcaaaggttcatgactggaggaacctcgaatagcatctttaacagttggtcaggagagatctgaaggatgagaccctggctcatatgtggcaagatgtacgggccgtcctgaggaaatgtgagagcgagcggcgggacacggaacgcgtcgggcaggctccgcaacaatgcagtgcgtagcagcaaccacccagcgggttcgggcggctagggagactgggcgctacaaagaaggggggcgtaccgcgcaggcgcaatccccgggtgggcgccgtgaacccgggccgggccgccgcggcggccgccagtgccgcccgcctccaagtggctcgcagcatgctcccagcagtcgagcccaccatccgcagcgcttgcaagttctcagcccatgctcccggaagtagctcccagcgctccggaagcgatacgacaggcgacgagcgccctccgcctagctttcggtgtgagacgtagagccgagcgaacgcggcggcgaacgaggtgaggtggggccgggcccagcccggcgtcgcgcgtgcggggtccctgactgccagcagggtggtggaggcgtgctccgggctggcgtccgccccggggcctgcggaagccttctgggcgccgctggctgccggcgcgccaggcctccaggcctcactgtcgtagccctctctcaccccagatgccggtggccgtgggtccctatgggcagtcccagcccagctgcttcgaccgtgtgaagatgggctttgtcatgggttgcgccgtgggcatggcggccggggcgctgttcggcaccttctcctgtctcaggtgagcctcgcgggcgggacttcctgggatccacggacacttagtcgaggttggaagcccagtgcttagggatctgagctctggagtcaaaatggctttgtgactcctttgtagtttagtaaccttaggcaagttagatgccgtttcctcagctgtggtcgaggacagtacgcttacctccacttttctaagaaccgatcatactagtatgctttccataaactctagcatgtcgtaaatgcgcagtgaaagcttattgttgcatggcattttaacttacaactgaatgtgataaaatgagcttgtagagccattttccgataaacttaattctgagatacacggttattctaaaggccatctccactatttattcagttcttgttaaatgtgctaatgtgtagtgaatcagtttgtaaagtttcactttacactttgagcagcttataaactggccaactttttaatctgggttaaactccaaaaataaacactaaggcatcatctataagacaaaaaggtctattaggtaacacacccatagaagcagtcatgactgcatttcctgccattacatgtccttctgttcctcttcctgctacaaacagaagagaattctgtacgtaatgccctagagcccttagatgttttacttgtcactgctaatcctccttggggaaagagtaacatcttaagaatgacaaagataaaggtattatcaagctgttaattcttgatatatttcaacaatgattataaagggtgaaggaaggtaattcaaaatctttcgtctatttttattcctaaatgatcgcatcttcctcctcaggatcggaatgcggggtcgggagctgatgggcggcattggtaaaaccatgatgcagagtggcggaacctttggtacattcatggccatcggaatgggcatacgatgctaatcagggcagtgattagctggctacatctttactttcccattcatttcaacccttgtacaataataaagttttttcttctcagtcttgtctatttttactccaaaaaaacatcccaaagggctaaagaagttggtcagtccctgtatccccatagttacattttctagctcctgttgcttagggtcttctggcctgtgcaggcatcagacacatacatggtacaccttatattacatccaaggatgcaatacttaaatctctagccaggcttaatgtgttgacatacacatttaatcctggtgcgatggaagtggaggcagccattgctagatagacctgtccaaaaacatttttttaaaaatatttgagctaataaaaatgagaagtcccaacagatgatggtacacgcctttaattccagcacttggcacaggcaggtggatctctgcattatggtctacagagccgagttccgggataggctccaaagttgagtacagagaaacactgatcagaaaaaagttttttttttttcacaaatcctgtttctgcatatcaaatatagtaaacatttgcttcttggcaaaagtagacaatttggacatggtcacatacactacatgtcacattcacaatagaacattgcatgtcctgagattgtcttcctaactttagacggaatgatttattgaaaaggccagtttctcaaggactgtatctttatcaggacattcctaacagcctcaaaattggacattagaatgtaatatccagaccaaagatttttctgatgtggattacccttcaactaaattttgatcagaatgctaatgcaatgtccttaggacatcaaagcccttttgaagccctagatgccaaagggccccagccggctgagtggcaaactcagccatcttgttttcattgttcacccaaggattgcaaaactattagaaaacacatgggcaagagttggaggatctgccaaccaaaggataatgttcaaaccaagagaaaggcctcagctccatctagggctcccgaagatgcccaggccccatagaaaaggtttctgtcaacatgaacacagatggactggtgtaacacacaatttgcagatcatcaggacgatattgctgctttttacaaataaactagaggtaagatctgtgtaaaagtgttttgagggcataaaaagaaactcaagatttagcatctacagatttcttatcaaagagttgcaactgcaattaaatggacttcactcagaatggactcttcaaaatactttctgtgcatcttatacaagaaacaagataacaagaggcagcttgtttgacccagggaacataccttcattgcaaacactatgctgtatgtattgacacatatatacaatttcaagattgcagaggttgagagagtagcattttcaaattgtgaaaaacctaaactgtaatgcttagacgctaatttgaaagcaaaagagaaaacaatcaccgacagcctatgctccagttagtaacctcaaaatttaaaaaaatgaaaattttcttgtggcctttttcagagaattttatttgagtggttcttacaaagattgttgcaatatgaaagtcatttgtttgatagaaatatcaagctgtcttgtcaaacacactgaagtaacccaaaaatatatttcagagctcacagagcttaaaaagagcaaagattatatgcaaccagacaaaacctatttctgcatttcctatatcttgcccagacttctttgctcaaactgttacatcaaccatcttcaggaaatgcagggatcattttgtttggaaactcaagacacactaaaacacagtatttacaaagaaacttttacacatacattaattgaaaagttaccatcaagaaatataattttgaaataccttcttgccaaatgatcaaggtgagatgctaaacagcctcttagctgcctagactattcatacactgtgtattccagaaacctttgctgaaccatgagccaaatacatgaatgaatgtgaactgtaactgctatgtaaaaagttaggcttctgaaacattaaaatattacctgtctgcctttatacagaaaggacatttgttcccctagagctattctatagatccttaatgtaattttctacatggacatttaaaacggcagaacaagcgaacagctttgcataaagtaggatttgctagttagggagaatgagcacactgcattcctgttaacatctttatttttcaagataacaggagttgtatacaaatgacagtagacccttgcctctttatttttatctaaataaaagataactcaagatgaattctcaagaaaaaaaaaaagctatatacataagggactatatcttccttcatcgtctacttggaaccagtagttgtgttgctgtcatagaatcaggaaagaggttgtggtaagttggaagaggtacatatgcagctgttatcattttacctgttgacaaaaagaaaaaaagttgagtgattactttcatgttatcactaggtgttcaacataaagtctttgtagcagtcactcaccagcaaaccacctgccatgcaatgcattgacagcagcaatagctgcagcaatagatgggcacttcacatatacgttgccctgaaagcatatcaagaaaaaatcgtaattagaaacaactgtattgaccacatattctcacaaagaaaaaaaagcaaaaacaaaaatgaaaatacctgagctgaatttttgtcaacataaatatgaataactcctccatgtttattacattcttcaataacatcatctttaatctctgtatcccatccaacttcttcttctctgtaagaaagcagaaagataatagaattgtattcaaataggaaaggtgcacacattatctgtgtatgtatggccatgtaggttgacccgtcagagggagaccattctccttgtcactatatgggtatcaagtgatccaaatctagtcctcacacagcaagcacctttgctcactgaaccacctaatgtgccttacaccatgcagtaagtctcttcaagaagcataactattcgatgggcaaaggtggtgcactcatttaaacccagcactcgggaggcagaggcaggcagatcttatgagttagaggccagcctggtctacccagccagttccaggacaggctccaaagctacagagaaactcttgtcacaaaaacaaacaacaaacaaaacaacaattcagctgggctaggaaacaaatgagctcactccatgaacctgcctatttatacccaactcaaaactgccattcatgcaaacatggcaactaacaatacattctgagccatctacctagaagctaagcatatattcttaacatttaaggtatcaaagggtatgaagcataaaaagatatacaaggtgttccatttgagcttattgttactaccattgtaaatttttgtggaactggctcagtagttgacagcactggcaaatgtgtggcacatatacaaacatgcagaaatactcatattcataaaataattttaaacaaagcaaaaagaattacaagtacacaaatacatggtatttgtggccacacagaaatttatcattaacagagtttaaatttcagctttgctatgtgcccaaataaaatataaactgcgtaaaaaagtgtcaactatttatcataatactttccaactatgaaatattaaaaatgggaaattgccaattgcaaacacacttacgtttgagggttaaacatgttagaaagttgaaaacattgtgttgcaagtggttgaacagacgcagctgcagctaaagctgaggctaaaaaagaagaggaaaaattagattcctggaatatgtgtgaacatccttggacaattacctaaaaagaaaaaccaccctatcttaatgtggaggagatattttccaatcaccatcaacagttgctcattatatcatgacagtaatagtaacacaacagttaagctgttaaattaagcttataagattaactaacttataataggtaacacaatgtataaatactcaagtattctttagagatgagatggggaaaacagtgcagacatacagacagaaatttggtacagatgtaaatatatttccctaaagatttcaggaactgggtttgtgacttagttgtcaatgtgcttgtctagcaggcacaaagctctgggtttgatcctcaacactgaataaactgggtgcatctataatttcagcctaaggaaggtagaggcaggaaaatgagacgttcacagtcacacagtctatcataccaaattttaagtaagactgcaacatataaaatactgtctctaagaaaatatacaaaaacagtgtttgaaatggggaatagttgcacaggaggaagcaggaggatttgtttatagagttctaggtcccctgggctagaaagtaaattgtgggatatccaggactacagaagagaccttttctcaaaccaaacaaaacctaagaagagcttgagaacagacatgtagtctaaatctattaaattacagcaaacaaacctcgatacaaatcattccagaatgaacaaaggctaaaaagaagtttgatcttattctgaagtgatgggaatgacaaaaaatggaattgttggaaaaatactaaatacaacacccttctacttctcttggttttaacaggaatatagttttctttttaaaagacacaggtctgtattttagatctatagacatctcagattcagtcatctcaactacccctcaagatttatttttactttcatctgtatgtatgtacctgatggcctcaaagggacaccctgatatgttcttcatagtgctgtgaactaccatatggattctaggaaccaaacctgggtacggaagtaagggttcaagtgctctaaatcagggagcaatctctctggtccaactactttttttcaatgcacgaaccttaatattattaaggttttaaaagaaaaaagtatccaaaggaaaaaaaatgccattgtaaacattttacttgatttttcttaggaaaacagaaacaaaaagaatggtatagtatgactattataatttggacataatggacaatgcaacgcttaaagtaacattgtaacattaaagcatacataggtgtagttaaacactttttccaaattaggtgttttccaagtttggcattctttaggtttgggttttctgttgttgagacagggacttgtctctctccagttttcacagaatcaccaaaaaattaattatagcaccagttacagaactcaccgtaatcatattatctgaccatatcccattccaatgcataacaacaaacagctaaggataaaataatgcattaagaaatcgagataactaaaataaatgatcacctaagtaccagacaaattgcactgaaaaaaactttacaaatatacatgaaataaataacaccactaaaaaattattctggtattttgtgctttctggttaaaaaaaaaaaaagtgcttttccttcattaatcctttagataaaaaaggtaatttcctttaacaacaaaacttttctgtgtatttctttctgagaacaaatattaactgccatagtctaagagctagtaattctcagctagctacttaggaatctaagggctgttaaagagaaaccctgtctcaaaaaacaaaacaccaaaacagaaagaaaacattaacccattgtacatttaaatattccaggctctaggaggcagagtcaagtgatctgacttataggacagtcttgttctacatacatagttgcaacacagtcagagtgacaaccctgtctccccaaaaataaataaaaacacaagtatgcataactaaaatgttttaagaagactgaagggaactactgaatgattatgaatagtacagatgaagcaaattacaataggatcattctggcttaatctacgcagcatgcagaagaataaagaattctgactttcaatcgataaattattaaaaaagcagtaattacaaatgttgcatttgcttaaagagaattaaaatatatttaaatctcatctaaaatataacaagatgttttttttttcacataggatcattatcaaaaaacaataatcatgctactctaaaggtagtactgaacaagaacactgaagagaaccctatgaggtggatttcatgaaatcattgcctacttgccatcatttcaaaatgcatgtaatatatttgaacagtttatgggcccattcatggtttttgatattacaggctactagaaaccaatcagtgtatcagtattaaacatctagcccacatgactataaatctaagtaaacttatgttacatatattccacgttctaaatctggtctgggaaaatactgagtctactaagtaaaccttacacctagagaaatacaagaaagaaatacaagactgagttctggttcgtacgtgtttaactgtcaaggagagagtgctagcatgctaggccagggattaaacagctacagcttaaggctgaaaaattcaagtaatccaaaacagaaacaaccacagataattttatcttctttgactcaaaatttagttgattaagtttaactagttatattacactgaaaaaaataaatccaaacaaccattaaaacaaattctatctttgtacatttaattgtatttcaaagacaaaaaaagtgaaaaataagtaactcaccttcagtctgttgggaaagtcgtgtttgcaaatctataacaaaagagaattctacagctcagtgcaggaacaatgaagagcctcaactaacagggtaaatgtcaggaaagtattaataaaagaggacttcaacagcagggtttattagaataaacttatcaaaacctggcagcaaaacctccttccccattcctcattgagaaggctttggggccttttgttgcctcatatcgtggaagttattcacctttcctcctaaccctaatacatcctttcctatcatatgtgtgctgcactgtgataccacagccaggaataatgggaaatggggaaagggaagcacaccggcgagaaaatatgtgaaacaccctgattgagaattcaattccaagtacttagaaagtaagttttcttttgttttttcagtggtaataagcactaagtatttcagaaggttatgttaaaatggtaaaccttaactaccacacacataagggagctagagctaggaccatgttccctaatttcccaatttagcaataactgagaaagagacaattgcaacaatgtggaatttatctttttatgagattttcagaagccgggcagtggtggtgcacacctttaatccccagcactccactgtcagaggcaggtggatctctgtcagtttgagaccaggctggtcaacaaaagagctagttctaaaacagcccccagaaccacagagataccctgttttgaaactgccacccctttcctccccaaatttcaacttgtcaatggtttctagcacaggttaacaatttgatgtaagtttattctctcacatatgatgaaaattattgtttctacactggaaagcattttcaacaaatctgtatgagctgcaaaccaaattcaagcagctaataggtgtggccaatcagcaacaacagagtaggagtcaggcaactctctgcttgaggcgagcttgatctacatagtgaatttcagaacagccagctaggggatcatcacagtgagaccttgtctcaaataccaaaacaaactcctgcatttctgcaaagctactacagctaataaaaacaccataagaaataaatatggcattattagtgatgaaggaatgtatttatactaaatgaattaagatattaatatagaaccagtgtcagaaacttaaaatacaatctctcttcttcaccccaaataggtgatgctattaattgccaatcccgattatgatgttaaaaacaactttggagctaggtggtggtatcacacatctttaaccccagcacttgagaagcagaggcaggcagatctctgtgaatttaaggctccaaaactatagagaaaccctgtctggaaaaacaaaccaacaataaaacctttggctacttttaatacattagtaaactaagcacaaattgtgtattttacacaaggaacattagaaaagttgtattatctaagggttttggaacactccgtaaatcccagtactcaggaaaggcagaattaagctcaatgcctggctgtttaaagcagggaacaaccacatgtggaccacaccaccttgaatgagatctggtgccagtctgcagggcacatacaggcagaacactggatacgtaataaataaatctttaacataagttcaaggccagcctcggttatatacacaagtctctaaagcctgggataccccaaaaagagaatactttgagggacaaggctgaccagcagaataactgagttgtatgatacagagcaaaattgaagcaaaccagggatatccaataacatcctgtctcaataatgacaatctggatataaacctaatacataaatgagaaagctgcaactctgtccacagttggatctctgaatcacatgtacatggtggaaggatagagcaacacagctaaaatgccctctgatctccacacataaggaaagcaaatgaaactacacagagacacactagctcccaaagtgaatttctctttaaatgtgtatgtttatttttgcctggatgtatgtctgtgaaacatgggtgtcagaaggcatcatttcccctgcaagaggagttatatatagttagctgtgagtcatcaggtgggtacatagaatacacccagaatcctatgtaagaacagccaatgctcgtatgccactatgaagcccttacacctaacaatttcactaaagacaacccggacaaatcatcctgagggttagtaaaagacatatttttttttattttttaaaaaatcttctaaatctatttatttattatgtatacaacattctgcttccatgtatatctgcacaccagaagagggcaccagatcgcataacggatggctgtgagccaccatgtggttgttgggatttgaactcaggacctctggaagagcagtcagtgctcttaacctctgagccatctctccatcccaagaaatagacatcttattcgggaaatagcatgatatatatacctcaggttggcctgggactcatttcaggacagtttactcatagaaacatagccactaaagttacatggattacaggagtgagcagaccttgccaaaccttgctcctatgtcctcaccttcatgttgagaaatcacgttttcacagagtaacctaagactatgagaaatgttatttatcacaacatgaggaaatgtaaaaaaggccacggcaataaggttaaaaaccactgctctttctaagagcacccttttttcaaatgaaaatttgaccttgaaagaagggaagtaacaatagaacagttttcaagttaaatcattatttttggtggcaggatctcgctacacagtccctgctatccaagagctcacttggataaaacatagtgagctttgaccaccaaagcactgagattaggggccggagagagggctcagcagttaagagcacttaagagttcttccagaggtcctgagttccaattaccgacaaccacatggtggctcacaaccaccttgaatgagatctggtgccctctgctggtgtacaggcagaagactgtatacataataaatcaaacacacacacacacacacacaaagcaccgagattaaaagtgaacattgccagatttagcctatcatgtttttttgtatagctttggagcctgtcctgcagcccattctgtagacctggctggagacaactaacatccgcttgcctctaccttccaagggtgggaattcaagaagcgtgctagcatcatcctgctgtatcgttttttaaagaattgttttcatctttctgtgtagaggtcaatgtgaatgcatatccaaagagttaaattcatcttaacatcccatactcaaggaaatttctaaaataaattcctttcaattacagaaagctgcttggaatgactattaattgactgcacaacaaacaaacctaacattaaggttttaaaattcaaaagcagaaatacaggtaacagatacttgtgggagattaccaaatagtgcttacagaaatgcctcaatgattacttttacctcctcataattaattacattggcattgtcttcagaaattgtaagttgcataagattttaaaggacaccatttgacaaaaagaaagtctttcttgcttttaaagtgtcaaaatatgaagacaagatcactaacttcacatttcttaaattattttgaagtattgcatatggatgaatctgttggcaggtattgtgactggacagggacttaaagctagtgctgggaatttagatactttaaaagagcagtacatgcttttaaactgaggaaaaatctgaagcctcatcctcatttgttttggttttgaagacaaggttcttctgtgtaacagctctggctgtcctggaaatgtttatagagcaggctggcttctaagttacagagatccaaccacctgtctacacctctcagtgctggcattacaggcatgtatcaccaccaccaggcactggcccctacttctttttttttattgtgccctaggcatgaaacagctttggccaccaaaccaggcatcaagctaggatgaacaaagggctactagctcctctgcccctgactgatataagaacaacaccaccaccaaggtgtctctatgcccattgccaggggttcatccctacttcttaatggcaaaataaaattacctgctttagatagctttgtatctaagcagatttaataagaaagcacaagtttcttattacattaacattactacttatctaaaactgcacatggtcttactttctagaaaacttagaacagaaattactattagaatttcagaacacttgataaaacagggtctggacactgccacccaggctggcatggaaatcatggtaaagcagcctgacttttttttttaaccaaagttggtatagcaaaagttattattcatttctatccaagacatatatataaagaaacaagtattaccctaggtcctagatttaggacaatgtaaatctctttttaggatttacttaatttctatttgaatacaacttttgcctccatgtatatatctgtaagacatatgacctgcaaatattagaagacatggatagatgtgacaatactggagattactttagaaatattattattattattgcataaagcaaaagttaattttaaccaactctgggcttttcctaaacattaacaattcagtctaaaacttcacatgtttccatagtctcatgggtcactctggctaatactaaagtatactaaagctactcttcttttgcaaccattaaggtgctagaagtacttaatgaattgaattctcagttagtcctttgaaatgcaaaaaatttggcatgttttcgaattaggtgaaaaaacaaatgatttcaaattagaaaagattcaattcctacctgccacagcaccaaatgccaaagagccactcatttgtaaagcttgctgtgctgctggtggaatctgcaaacctgtacctgtaaaagagtaagtcttaaagttcttactatgttaacggcaaaaaaccccacaattttgggaattatgttatcaactcagtcatcggcaaaatggttcactacaccaaggtaaaataatcacaactaacttttttttttggttttttttttttttctgtgtatctttggagcctatcctggcactcacagagatctgcctgcctctgcctcccgagtgatggaattaaaggcgtgcgcaaccaactcgaagctaatcacaacaaatttcttactgagtctggtgacacacaaaataaaactcattaaactcacagtagtacacaaaaacaccaaaataaggagtatataaaactttaataaaggtaaagattagaatgcactcctacaaatatataggaactccaaaacaatacacctgcctgcatatttcgtagtttgcatggttacctttctttttcaccactatacctatacatcaataattgaaaacttaccctctgcaagtctcgccattaactggagacgaccagttgttcccaagtcaattccagttctttctagttcatcactgtccaaaaatgaactagcactagaagcatcagttcgttcagtaacatgaccaactttcattggccttccagctagttcaaatccattaagctgttccaaagcttttttggcacattctgagtcagaaaactagaatagacaataggaatgatacaattgaatactttgtatttgtatcactacagacataacattgccttcaagtgcattggtgtcaatttgcttgaatgcacgttgtgagggtgtcagacaagttgtgagctgccacatggctgcttggagttgaacgcaggtcctcttgatgagcagtcagtgctcttaacaactgtgccatctatccagcccccaaaatagcaactttgtaagtctaattacacactcatgaaaaagtacaaaaagtatataaaaattgtgtacatgtaaaattagaccataaatttttgcaaataaaaatgcaagatagtgtgaaaatgattttttttaaagaccaatttttacttttttgacaagttgtctttacataagacatgacttttttatttttatttttaaattttttcgagacagggtttctctgtggcttgggaggctgtcccgaaattagctcttataaaccaggctggtctggaactcatggagatccatctgcctctgcctccctagtgctgggattaaaggcgtgcaccaccaacgcctgggcccataagacaaaacttttggacaagtatttactatgtagatcaagctggcctttaactcctccctccctgagactcataatttgttccaaaatgccaagaaccctatgtaattttttagtgaatctgacagagtggaaaagagtgacaggcacctaggatcttaaacgtgtaacatgattacccaaccaaccaaatctaccaaaggtgttttccttcacacctctcctttagtctccagatcccttctcactgtctttacctctttctaaacaggggtaagaggatcctgccaggcagtggtggttcacgcctttaatcccagcactcaggaggcagaggcaggcagatctctgtgtgttcgagaccagcctggtctccagagcaagtgccaggataggctccaaagccacacagaaaaaccctgtctcaaaaaagcaaaaaacaaacaaaagagctgggtgttggtgggtcatgccttttagtcccacactggggaggcaagctgatatctgtgagttcagggccagcctgtctacagacagcctccaaatccacagagaaaccaatttagtttgtgcttttaacgccaggatatgggaggcagatcaagtcatttgttattttgaggcccgcttggcgtcttccagttgctagggttacactgagaggccagctctcaaaataaacaaggacataataaataaataatcaaataaatgtgggctccaagttagaggtagatctgataccactatactctatgtgcaccagaatttaaatgcacaaagcaaactacttgaaaatactaatctttcttcattcccaacacatacagttcacatattgtgttacattaagagaactacttactgtaatgaatccatatcccttagaccggcctgtttcactatccatcatgagctgaatactttcaatctaaaatttaatggcataaatttaggcaaaattattctgtgagctatagttttaaaaaatctgaaatattctgtacccttataccccagccctcaagtaatgaagacatcacaaccattctttacaaaaaaaaatttttttttcatggcctagaatttttaaaaattttcccactttgacagggaaatactgtctggagtcagggaactaaacaaaaaactaaaacttacccttccaaaaggctcaaatatcccccgaagcatatcttcagttatgttaaaatgtaatgagcccacgtagagcctcatgggtccagcacttcccttttgtaaattgtttgccattgcagcagctctgtttttttctgcctgtaagtaaaacccacatcaaatactaataaaaagcagaaatgtgtcaatgacaaaggagcactaagattggaaagccaaaaactatgagtaaaaaggaaaaaaataaaccctaaattgattgctaggaggcactgaaaatacacaaatctgtagaagacatttgctaagaactagtgtaaagagaaacatcatcagaaagatgtaggtgagatatataccatgctgtgaatgtcattaatggcactaaattgaatgcaagagttgtgacacagcatattaaactcaaatgtctgccttctgtgcaagcactctactgagctacattccattaccctaaacttttgcactcaatagcagatgtgccaacggtggtattatacaatttttataacgtttaaagtatatgacaattatatacaaaactatatactcatgtttcatacctatatgtaatccactataaaacttaaaccaagtcaggtggtgagggcacaagcctttattcccagccctggtctacataacaatttgcaggatagccagggcagttacatggagaaaccatgtcttgaaagaaaacaaataaattaagccaaaatatcttgttttgtgatatcacaaccagtgaaaaatacaaataatctgtttactgaatatttgtaaacatataactcattattagacataccccaagatgagtttgagagttgaatgaatgtcttagcaaaccatgactaagtgtttgaagaaccatatacatagtcacctaagtaaagcatagctattttgtctctattaagacaacctttttttttttttttttttttggttttgacacagggtttctctgtattgtttgagggtgtcctggcacttgctctggaggcttttggaggactttggaggctgtcctggaactagctcttatagaccagcctggtctcgaactcacagagatctgcctgtctctgcctcccaagtgctgggatgaaaggcgtgttccactaccgcctggctctattaagaccttttaaaactttttatatgctgtaggtgtttgtctgcttcagaataggccagaaagatatcaggtccgatgaatcgacagccacaaaacagctgtgcatgtggatgatcaaaatgcagaaggtggcctatagccacagcaagtgctctttaactatggagccatctaaaaaccgtagctacattaatactttctaaattctcaatctacattataaaacaaactatctttctaataacaaactgctagagagcactcactcacggaccagtgcttcccacacaatgatgtaaactaccatctcattgattccacttattaggtctgttaatgaataattaatacatagcccaagctgagtcaaattgattccaattctcctgcctaaccctaagccactgctgcatatgctgtgacacccagctcaatgaccaatatctaaatcaagaagttacctgtgatgcctgtactataattggcactcctaaaacacgttggccagttaatccaattgctagaggcactgaactaacatcaacaaattccacataggcaattcctttggaacgtcttgaatttctatcagaaatcatcctcacatctcgaacctaaaatgaaaagaaatataattattctatagtcaaacaatccacgtaagtatttcaaacatactatttcttcagaaacagtgtctcaatcaatacatggcaccagggttaaacgttttgtgtagacttgattacccttaaattcacataattctgtatacctctgtcttcagaatgccaaaattaaatttcagtagtcaggcaaggtgttagtacatgtatttaaaatagagcactaaggatatctctaaggtggatttctgagtttcaggtgagcctgcactacacaatgaagactcaataaagatagggtgtcagagcctggcgttggtggtgcacgcctttaatcccagcactcgggaggaagaagcagatggatctctgtgagatcgaggccagcctggtctccagagtgagtgccaggataggctcatttttagagacagagaaaccctgtctcgagaaaaaaaaaaaaaaaaaaaaaaaagatagggtgtcagtatttatgtccatcttatgaaaacttatatccttctacctcagtaataggattacattatccaagaactgcttctaaaaataattggagatgccctgcatttgtggtacacaccttaaatcccagcaattgggaagcagagacaggcccagcctggtctacagaatgagttctaggacatgacccaaagctacagagaaacccagtctcaataaaaggaaacaaaccagcttggtctataaaagctagttctaggacagcctacaaagccacagagaaaccctgccttaaaacccacccaacacacagaatttggtctgcctgtgactccaagtgattaaaggcatttgccaatcaccccttccgtttttattgaatctattgaaattacctattgctgttatccttgagtacattccaaaatttgaagctaagaccctattgttaattatataagcacaatgtatggaaataggacttggaggaatttggctgaactgaactggaggactctctcatagtactggaaggagctaatacaagcttccaagggagaaagcaatcaatagtcttaccctgctgtgacacctccaaaacacaatgatgatcaacaggaagatttcccaaaagatacaatgtggcactttgttgtttttccagacacggtttctctgtattgcgctggagcctgtcctggaactttcgctggattaaagttttatgttagggctggggggatgcctcagccaatgtggcactttcatcttgaggattaccacaaactgtctatttgaactcacagctgactaaacagaagagaattcataatccattcctgcaatgtaaacttacttaactgcgtttgatgaggccaaagaggcaagaaaataagctaataaggccatttcagaatgcaaccactaaatcatggggtatccaggcctaaatgatacatttgtaacacatccctaacttaattatgacagggaagctgcactaaggaaatgtaaacaataaagcaggaaaacaagacataccaaggtagacatggaggtccttagtattggttacccaatactaagtattatttgaataaaactattaatctacaaagaccactaaatgtactcactagaaatacacacacacacacacacacacacacacacacacacacacacacacacacacacacacacacaaataatagctattattataattagagctgggtatttgtggcatgtctttaatcccagcactccggaggcagaggcaggtagatctctgtgagtttcagaccagcctggtctacaagagctagttccaggatagcctccaaagccagagaaaccgggtcttgaaaacaaaacaaaactcacctttttttttttgagataggatttcactctggccctggctgtcctagaactcaatctatagacctacctgagtgcctggccttctgactgccaccactgcctgtgtgcctcacttctaccaacttaacagtctcttataaatggggagttacctttcctactgtagagaaaaactcttccaaatcccttggtcgaattcttgctgccagttgcatgcagaaaactgtccttgcatctctttcctcaggagttagattatcaataggttccctaagaggagaagattacaaaattaataactgcaacattttttagtgggacacaagattattttgatcattggtagcctcaaaatccagttctttgttttactagacataagattttcttgccgggcggtggtggtgcacgcctttaatcccagcacttaggaagcagaggtaggcgggtctctgtgagttttaggccagcctggtctccagaacaagtaccatgataggcttcaaaactacacagagaaatcgggtcttgaaaaaccaacccccgccccattaaagcctaagaagctagagggttcagaaattaaggacatgtattgctcttctcaaggacttaattttggtgcacagcaccatgttgagtggctataactctagttccatggcctcttgggatagcagcattaacataaatacatttgtattaaataaacattttttgttctctctttactctattttgaaacactaattcctgaaaagtcttattaaagtttaccaagatatcagtggataattttgtttgtaaagttgtagatgaaatcatgatatccaagtgctgtaccactggtacacttacaagtcccacatgttaacgtcaaaaggtataaaactgaattagattttacaagtaaacagattactaagaatatcacaataagccgggcattggtggcccacacctttaatcacagcactcaggaggcagaggcaggcagatcactgtgagttttagttctaggactaaagccagagaaaacctgtctctaaaaaccaaaacaaactatcagggctggagagatagctcaagagtttaagcgcactaactactcttctaggtcctcagttcatgtgccaacagccatctataatgagatttgataccctccttcttctggtatgcaggcatacatagacagaatttctgcttataataaataagtctttaaaaataaataaatgaaagtaattgtaaatcttccccttaaggtcaacaaggttagtgaagtatgtaccgtattacaaaatgtgccttgaaacaagatgatcattatagtctaaacttactgaggaagaaaataagttgaagaatattcaatgatcattatgtaaactcaaaatgttttggtgttttgtttgcagatggggggaaaaaaaggtcagcggttacctcacagggctcttgtcttttctgaatggacttttgcttcgggaacgtcttctgctgtaagggtaaaaagtttcacaagttacccaaacaagtaatgtctcattagttccttgaaaaacaatttaagcaattcagaagtgtgtttaaaaaccttaatttgatgctatgaggcaacccaatctttcctcggatggcactgttaaattttggtccggagctaaaaagaaaacacaaaattacactagttacaggtttagggtcttgccaagatcaagttcatgggctctccagcaagactaacattgtttaggctgcttcttttctacatcaactataaaaaggaaacaaaagaacttagaaaaatttgtatctttatccctgacctgaagcccttgtatttatctatcctggatgagttagaggtgccaagaacaaacgttacagcttcaaaattttctcactctaaaaatggattgcatctacttttagtttttcaaccatgtaattatgaacatgagttgttaaaatttagtagagtaaaaacaaatgattctgaaccctcatcccagcatcagtttactatacagttctttcttggaaaaaatatgtacttatatgaactcactctgtagtaaagaatgaccaagaactcctgttcctgcattgctaatctctgggaggatttaaaaaaaaaaaatgcatcaaaccatgaaaactggtacgttccatataatacatccctttctttttttaagacagaacaaccctcatagtgctggaacttactatattacatatcaggccagcctcacagagattctacctgcctctgcctcctgagattattattattttttttttggtgtttttcgagacagggtttctctgtggctttggaggctgccctgaaactagctcttgtagacccttggccccccagtgctgcgactaaatgcatttgccaccagggcacggacttttaaaattttatgacaggttctcactgtgtagtcctagttggtggaactcaaaaaagcctatctggagtgctggaattaaatgcatttgtcaccatactcagctcccatgtaataattcattttattacatttttaactatttttaaaattattttatgtgcattggtgtttagcctacatgtgtatctgtttgagggtgtcagctcttggaattacagacagttctgagctgccatgggagtacctggaactgaacctgggtcctttggaagagtagacagtgctcttacccactgttggcactgcaactcaggacctctgaagagcagttagtgctcttaagctctgaggaagctctccagccctgatttatgtttttaatgcagagtatatccctttgtagccctcacccacttggaacaggtaacaacatcatcagcagcaagaacaaggaagcaaatcagaattctaaaaggttattatcctaaggagctaaagggttcagcaattaaggatatgtattcctcttcccacgtaaccagtgttattaaatgttgagccatttttctagctccccccaccctcttttttatcaatatggactagaacttagctgtgatcctcctcttccttactaacccctaataagataattactggaattcatgtaatcatataaacaatttttataacttatattttatgtgcactggtgttttgcatacatttacgtctgtgtgaaggtgtcactgttacagacagttgtgagcagccatgtgggtgcagggaattaaaacaggatcttcaggaaatgtctgctcttaaccccagaaccatctgtctagcaccataaaaaagtaaaatttaacaaggcattttttatcctgttacaaattaatacagattggtatttaggagtcagggtatcactatgcatccctagctgacacatggtaaagtaagccaactaggtttctcctttagttataactgtggagtccagttatagacgccacagttcattgaaacccaacaccagtttaaataaagtcagactaggataagaagcaggcacagacagacatagacaccacagacactcacatatcacccatccatactctacaaatggtattctcatgttttggggtttgtttgtttttgagacagagtttctctgtgtagctttgtagagcaggctggcctgtaactcagagatcccccgcctttgtctcctgagtgctgggactaaaggggtgcaaccatcaacgctcagtattctaatttttaaagaaactatatccatttagttcatcctggtaagacaattaacaatcctaaaaaatgtagagtagcagggcgttggtggtgcacgcctttaatcccagcgctcaggaggcagaggcaggttgatctctgtgagttcgatgctagcctggtctacagagtgagttccaggactagctccaaagcaatacatagaaaccctgccttaagaagcagagaatgtacagtaactcttgaagaagaaacaatttctaatataaattcagcattaaaataccatcatggctctagtaatcatcatgtaaagtcttatagtaaagttacttatataagtaaagttacttatagtaactataagtaactaaaaggaccctataacctataaatatgggaagcatccacagactcaggcatgcatactaataaatgaaagccaatattctgagtattttgtagacaatcttcattactcattatgtccaagtgaattccttaacaaaagtgaaggggttgattcagttgagtgtctttgaactcaattcttaactacttcaacatttagaattaaacagttaagggcaatactgcttccacagagttcctgagttcagttctcagcatccacaaatcaagaagctcacaaacgcctcttaactccagctctagaagtactagaagtagagtgtagtccaatgcttttggcctacatggacacttgcactcactggcaacacacacaagcatatgtacatttaaaagtgatttacaatggtgtgcattttaaattgacaattgacaaaagattgttaattgtcttaccaggatgaactaaatggatatagtttctttaaaaattaggtaaggaccttgcttctttcaatcctttctcagaaatgcaatttcttcccaaaatacagatgaattttatgtgcattggtgctttgcctacatgtatgtctatgtgaggttgtcagggaagtattagaactgattttacagcctgttgtgagcagccttgtgggtactgggaattaaatctgtgtcctatggaagagcaatcagtgctgctcaaccccagccatctttctagccccagatgatttttttttcataagtgatgtcatccttttttaagcacagggtttctctgtggctttggagactgtcctcgaactagctcttgtagtccaggttggttgccaactcagataagtgatgtcatcttaaatatccttaaataatgcatgcaaatttttgttgtttttgagacagcatttctctgtgcagctttacagaccagagatctcacatagatccgcctgcctctgtgtctcaagtgctgggactaaaggtgtgggccaccactcccgggctacaaagcactttcaatttaaaggtttaaatacaaatagttaaaataatgagcctaaaagttgagaacacaaaatggtgacagatttcagctcaagacagccacaaataagattttctatccaaaactatacagtttagacacatattttgtatgatgagtgttctaatggctcacatactttaggttttctctatcaagtactcaaatgctttattttaatttggactggcaagcaatcaaagctggtcaaaaaatgttggtagttctggtagtttctaagtttttatataatcaatccacatactgtattttcaccttactaggggtcaatgtcagtatctttcattttaaatctgttattggaaaacacaatctcataatgctttcagttaaactattatctaaacacctgcaacaaaagtaattgcagttacatactagggacttctgtagcggcctcggaatcttctatctcgacttcgtgagcggcttcgtctcctttctttgcttctgcttcgtttccgttcacggcttttgctctttttcctttctctatctctacttcgcttccgttccttacttttgctcctttttcgctcatgactacgacttctgctcttgcttttttttctcctgggggagggaaaagtaccattatcatgctggtgtaaatactaagtaatatatacttccttttacggtcaaaatgtttatccttttgtaaatgtattttttaccactgtacaatggtacaaaatcatactttaggaaaaaattcctaggcatgggacctaaaaccccaacctttgcttcatgttaactgaatacaatcaaagaattgagagacaggtttaagaggaagaatttgcaatcatctcctgaggcagctacagcttgaaacaagagaccgggacttgctggtaagtagaaaccaagcctcaacttcaaaaacaatataattgccattcccctaatagaccaccaagcaaacagtaataaaagttacagtatgttcacatttaagaaatagtaattgtcatgtgaaaaatttccatacagtaatttagttcaagtcaattttgacacaatgtacatgtagtctgaactttcaaaacaccatatacatagcatttttgtttcataggaaaaattataagaaatgataaaggacattaagaatgcagtaaattcactttaacaagcccagttttaatgtgaccatttataaggtttccacttaaagctaggataaaaatggaaaatgccctttttaagctagtttatacaagcctatgggataaattaaaacaacttgaccttccttggaaaagtaaaaaaaagcccatcacttatcttcccatatatttctgtgttcctcacaatatttcacccactggtttaataatgaaaccttgaaatctgttcctctgtcatcacccaaattagaggtgccttcagatatttcaatgtaaatgaaagacatttcaaaataaatttattccaccaaaatgtccatttttaagtggtttgaagcctgaacattttgacaactctacatcattaggaaaattaattagctatttaatctgtatcaaagcaaagttagcacaagaaccactgaggcatgcctcagagaacctgtaagcaggtcatcttagagtgcactgaaaatagaaaatggaaacacccaccttctggaatctcgaaacccacactccaatcacaaggagatgtagagctttccaaggaggcagaaactttgtctaaaatttcaagataatccacctgactgtcagaaatatgctaggtagcacatgacacaaaattaggctacactcatttatacagaagtcaaagcaactccaatgctcaaaagggcaacaattaacattccaactttgatgtttcaaacactgacactatttcttaggactaaagaattctgaattctgtaaatcctaccaaattaggggacaaggtaaaaattaatttcattcccctggggggaaaaaaagacagcaagtttttgctctgctcaaaggcggcccacagcagagtcaatcttagtctgtcaaagaaacttaaaaaataactgagagagctaattttaactcaatgtcttgctagacgtttcataagcaaatccccacccacatctgaaggcaaccccagataggtaagtagacatactaagatatcagaaaattcaattttccatataaaagcccagacaaaagataaatgttgcaagaaacaaagatacttctctagagtaaattccagcattaaagaacattatcaactaaagaaatggttataaaaatccatcctaatagtcaaatcctgttacaacttaaatgggactttcccaagtctttagtggcagtggaatttgtactgaacatcattgaagtaaatggtccactgggcctttggactttttggttatatggcctctgctgtaaaggtgttttgctataactggatttgacctcttccatgtaagaagatctaaaatttaaatgcaaagtattctggaaaataagaaaaaaaaaatagaagtcatttattccaaaatttgataatccacaccacagtagccaatatattttaactgtgccattttactgttatccttttctaaatgattctttaaagactttaacaaaataaagtttgacttgagacttgcaaaacttgtcacagcaacatacttccctgaggacgaacctaagtccatagagagtttactggaggccttgacaaacttccgtgttacaactcttcagaaagtaggctaacaggctgttatttcaaacttcatcccttactactgggatatgacactgtgtgttacaagtcagttacaatttttttacacaagagtttatacacatagctaactttgtcagaatgtgaagtttcttctttctaccttatcagcaacaattacctccaattcaataaggttttaacatgagccatacaaaaatgttatctaccttaggtgaacacaaattatcttaaaatgagaaaatttatttttcatccacattaggttcaattactttttgtggcatgttccttcaaataactagataaaaactttgtgactacattaggcaatcacctaatttaaatcagctgtaattaaagaagccttgaacattttgaagatactactgattaaagtatttagggaagtcttcctttaaaacactatgttaaattgcccaactgactctatgcattagacaaaactacaatgactaacccccaccccaaaaagcacaatctctaatataatacatggtgctcaaatgggttataaaagcgtggtgatttttaatgaacttagacacaggattcaaagaaaaaactaaagatattggtggaaagaagtgacattaaagaatgtcaaagatttgcattcaagtttatcctcatccttttcaaccttaagatcaaaatctttactatgtcactataaatatgacatctgaagaaatttttgttccaggattttattttgattataaaattatgaagctgaaaatttaggaaactgttacactggcaaaggttaaaaatgcacgatatgaatcctgtcaacctgctctctgcatccacttctgaccagtatagaacctgattcaacccaatcatgcataagaaaaaatttacactaatcagacctgtgtttcctcttaatattaattcatttttgtattctctacaggatctcactatgaaacccaggctggcattgaatttattatgatcactatgcctctacctaaggagggagttataaacctacatccatacccaaacccacatactaatagtaatccattactacaccacattaaaattataaaccctttgcttagcaaacctaagtaacccattgagcattttctcatctattttatgaaattgtatcaacctacctaacaaagttgttgtgaggatgactgaggtagttactatgatgcactttgagctcttaggaggaaaagagccaaaaagagtcaagtaagtggctattttatcatcattttcattatttatcacggggtcatgatatgacaaacttttggtatggcatcataaacatgggctagaacttaatgcatatgaccatatcatgttaagaatcactaattttggagctaaatgctaattttacaacagctgataagctccaaccttataaattggatcctgtttaaactgttaacataactttgtatattgtattctgtactaagtctatagcatgaagttcttatttcagattactcacctaacccaaataaattacatattcttaacggtctccttagatacactaaagataaaaaggcccaaaacaatgaaggaaaaaattttacaaagaattactgccaaaagggcctttaagctgcaaggagcagaaataactcatagccaattcctttagtgaatgaaggtaaacacagtattttctgtggccttgatttgattttttttccaatgtaagtcttctaattcaatgattatcacatctccaaaaaaattaagccaaagttaccaaatttaaaacattatagaactcaagagaatcatgggatccttgaagggaaaagtgtccagaaggtctctgaaaccatatgctgaagtctacatcgcaaagtccatagttttaaatcctgaaggactttctcatcccaaagggtatgaccagttttctaagaagcgaagaaaaccacagtttgatgctttaggcacaagaacataagatttccaccacaagaagtttagagcccaccctcccaggttccttgttcaaacttactttttgctacgttcttcatggccgttagcactgctcaacttgttctcatcctaagcaaggttgatagaagaacatcatgaggacgaagtggtaacatttcaagttgtcaaagggtaaagggaataggaataagaaaatacaagacaattttaaaactaattacttatttagtctaacatggaaggctataaaaaaaatttagatggtatatgtttaaccactttgttgctaataattaagtcatcaagaaacaaaaaattaaaatctttccacattaacatgttatattttactttcttacattgtttagataataaataagttaaccagagttacaaaacgttgaagtggttattatttttatgaaacatgaagtcactgagttttattccatgtgctattgtcccttttgtcggtaccatggctctatttctgcctaagccccaagtggccatgctagcagccagccactatcgatttcctgtgaccgatgccattcctgagatcttcgcccatttccgctggagggttgggactgtaagagcttgatgccacctctgtcacacatctcgccctgaagcaaacagggattcacactgctttagtaatgttgactcccaagaacccaagaaaagttaattaataattcaccagtccagcctaaacatttcctacttccatacctgtttacatggaattacatccacgttaaactaagacaagaaacattaaaaacagcaaacacgtcttcaagagtctagcattataaattatactattttataactatcagaattcatccaaaaggaaccacatggtcgtgctacactccaaaacaaatgtattattttaaatggtttaagcgcaatgtttatttcaaagtttgaacacatcagctacgtagtatatctgctaagttacagaggctaaggtttgtgacaccagtgataatgcatgcatactgctattttcaccaccaagtgggggaagaaggaagagtgtttacttttactctgatactgaaacgggtcatattgtattactaatcaaaataactcctttgtagtttttagtgtgaaatacttcggcagggcctaattaaaaacaaaatactatggagaacagtaaaacagtcatcaagtgactctaatttgtgacattgcctcttgccttttgttttggtggttttatattgttttgttttggtttctgctaatgtctattcagggatccaagaatttcagtaattattaactgaaaagcagatcagcacctgcctgttttaaggttactatcgccagccttgtatctatttatataaaataaattttaaatctcacccatttcttctttaaagactcgtaagatttacttgccacagactggttatgatttattcttggacccctgctattttcccaaaccactacattcaccttttttgctataccaaactggagctggtaattcttagttgagtcattttacctaggggaccacggtacagcgataagtcactcaattactaccttatgattgacagttcacactggaatcaaaggtgaattcatgggagtagaggtgagatatcgttaggcaagtctacaaagagagatagatgggcatttattcatcacgctgaagtgaaactactgcacaatattattacatcaatagcatatatttacttttgtaagttacacgtaatgcatctctgataagataatcaagagggctccgggaaggttagtttacatttcagcagtagtttcgtgaataatgctaaattaagaaacatattaaagctcactggcatgtttttctcaccttcttgtaaggggcctcaagcatcgcctcaatatcaatatcgtctgccattttctctacacgcctagggaagaacaagacagtcctgttaagtaaacaacgactaattcgtctaaaaacactcgactcctcggcctaaaaaaaaaaaattcagatttttgagaaaagtccttagtttaaaaaaaaaaaaaaaaaagcccgacaacgactaaaactgcgcgacgcacgtcaacaaccagaggcttgacgtgggcgagcaaacgcgaagggctcctccttccagcaaacgcacgggccgagccccgcgtctcatcgcgcagggcggcccctgggcccccgaggcccgaccgcagcggcgtacggagcgcacccggggcttccttccgcacaaaacccgcgctgccatcttagcggcggggagcgccctccgcggggaggggttgtgtaccgaggcggcgttcggcaggcgccatgttggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaggtcgccatgaggcgcctatgacagaacgtagggccgcggggtgagcgttcgtgaggacgcgcgcaggctgcgcccgagtggggaataaagacttccgtgtccctgtcctctggtgtcgccgctgagaggcgaccgccgtgctgaagccacggaaaacaccgggaccctgacgagggcgggcggggagggaagaagtgcttcttccctcctctccggttccctcaccgcgggcggccttgtacaccctcagttcagtgggctgtgcgtcaggattgaggctttcttggattttggctgtccacgtgtaaatttaccgcttttttaatctgttttttcctggagtttttttttgcggggggggcgttaatactgtcgcagaggaaaagctgcgaggtcattgtaacttttgtttccccctttcataggaaagcaaacgtttaaaaataaaatgtgaaaccaattttgaaccctgtcagcagcttgagggtctaaaagagtcacagtgtgaacaccttgattggtgtgtagcttctgcaacgctgtgtgaccttgggcgagtcaattaagctctcggggcgtatatttcacttcctcctcataaagaaggagggagaatattgtaattagtagcaagggaaagcttgacactgaccaccaaggctgcaaatgttgatggaatgaattccaggtttagcagggaatgtctatccaggtgaactccatgaaacgaatgaaggctcattaggagaaggggtgaggaataagcgacatgatgactgaaatgctggaaaaataatattttcatcattgaaaacttctagggctgacaatgcagctctgttggcatattgcttacctagcatgcctgatggagcatgtctgtaattccagcactcagaaaacaggcaggggcctctttgtgaacatgagatcagcctactgtggggagctccaggccagccagaactacaaacaagacctagaggacatgtaaccataaagagactcaacactcaggaggcagaggcaggcagacctctgtgagtctgagtccagcctggtctacaaagcaagtaccctgacagccagaactacaaagagaaaccttgtctggaagaagaggaggggcaggtgaggggatgggaggttggggggagacttgctttctctctcagactttatagactgcctaagatccgggatagctccaactgaaaacctacacttcccaacttcccacccagtaaggggccctagtccttcctgcaggcattttgaccatggggtggaggcagacagaggtggcccttaccatgaatgaggatggtcttgccctctgttctctttagagctgtccttaacaatcctgtcctgggatgacaaatcaaggacaacctgtgacacctagtgaaagcctatgaaaaggacaaaaggggagctggagagaaggtagttaaggtcactgactgctcttgcaggggactgggttttgattcccagacttcatatacaaactagagtttgagaggatctctagcccagtggtggaggcgcacacctttaatcccagcaatacacccctattcccgaggcagatctctgtaagttcaaagccagcctggtctacagagatagttccaggacagcctccaaagccacagagaaatcctgtctcaaataaataaataataagtatgctggatctgtatatgctatggtttaatctacagtacactttaaatacttttctactttcaactttcaggcagaagtatattttcttgttttcatttgttttttttttttttttgttttgtttttttttggtttttcgagacaaggtttctctgtggcttcagaggctgtcctggaactagctcttgtagatcaagctgggcttgaactcacagagatctacctgcctctgcctcccgagtgctgggattaaaggcgtgcgccaccactgcccggcctgttttgtttttcaaaatagggtttctctgtgtagctttggagcctttcctggaactcattctgtagaccaggctgtccttgaaatcacatagatccacctgcctcttcctcctagagctggctttaaaggaatgcaccaccctgctcatgggccagatgttttatgacctggagggaatacttgtgtttatatggcttagctgctagagtagcaattctttagaaatcaatggacacaaggaaccttttaaattgtctcttgtcattggttaatacttcttgctagcttataatcaagaattccaccacagttagcaacatttgaaggttgctgacatagaaacaatattccttttacatacaattttcaaatgatgctaaaatagcaatgaaccatgcttaaggcctaagtatattggccttgaagtgtggctgtattactttcccagatattttcagagaatcttacaaactagattaaacatttgttaatagttaacaaaaataaagaaaaaaggaggaagaagcagcagaagtagtagtagtagtaatatatttggccaggcggtggtggcacacacctttaatctcagctctcgggaggcagaggcagaggcaggtggatctctgtgagttcgagaccagcctggtctataagacctagttccaggacagcctccaaagccacagagaaaacctgtctcaaaaaacaaaacaaacaaacaaaattattttatttgtttacattggttttttgagtcagggtttctctgtgcagctctgattgccccgggacttgctttataaacaagaccaggatagcctagaacagagattgtctgcctctgcttccccaagtgcgaggattaaaggagtgtatcaccatgccagtctccaaaaaagaaaaggtcattttgcaacactttgagatataacttcaaaagctacaaaacactatagctaccttaactatcctaaaaagctgctctctctcaccatttttttttttttaaagccaggatctctatgtagcttagaagtcactctgtagaccaggctggcctccaactcagagatctacctatctctgctgttattgttttgtttaaaaagaagaaaagagaaattgctgagacagacatattgactataagtttattataaggcccgtcagaatggggagactaagaggaggaacaggggtaaatggctgaccgccatggccggtcgccatagagagacagagcggggaaacagagacaggagagcacgcagagagagagagagacagggggagagagagagagagagagtaaaggggcaggagcttatcttttaaaggggtcctctgcacctgcttgcagacttctttcccatggaacctcgggctgaccagggtattgcctgagtggattccaccaggtaacaggggcaggccagcataatgcctgaacctttcatctgcctcccaagttccaggattaaagctgtggaccaccactgctgactcattcaaggtcttgtttgtgatctttttttttttatgaacatgctgctgagaatttatcaattttaacacttattttatgcatatggatgttttgattacatctgtacaccatgtgtgtgcctggtaccatcaagagaccaaaagagagaacatccaatcccttcagctggagttacatctgtgaggttccatgcgggtgctggaaggtatccagatcctctggaagaggggccagtgccctgaactgctgaaccgtctctccagaatacccccaaagagacttttttcacgaggtcaacatccttagcccttaaggaaatccattctggtgctcactttaaccccagcaagtaggcagatctctgtgtctgtgagtttcaggcccaggggctacatagtagaaaacctgtctttaaataaaatttattgtaacaggaaaaataaaagacccagaaactgatattggggttcaaactccaagctgaaggagagaaaagcaaagcagctggcactagctttcacctcaagttcaggctgaaggggctggtccacatatgagctcttcaccaagcctcaaactctacctctccccattgtggccagagaatcctgagacttcaatgtcttcctatcctctttgatactgagccttcctgtcttcagtgtgactggagaatcaatgactgataccgactagtgaagaccctgcttatatcttttataaccctctagccctgggtttaaagacatatgatctgttactcttttagactgattcaaccttgtgtccctgggtggtcttgaactctgagagatccatctacctctaatcctgacttgtacaactaaaggtgtgtaccaccacctcctagcttctggctgttgggattaagtgtatgcctggtttctatggcttgaggctgactttgcttcctgaatccttaggcaagctttaataaatcataaataatatatcatgacaatttattagtcaggtttctctagagaatagaagtgatggaatgaatgtatatgtatagattcatatatgtaggtgggatttattagttgtgttctgagtagctcaacaatggctgtcttcttacagaaagataaaggacctgctagttgttcattccaggagactggatgtctcagctgtcacaatttgctgctaaggtcaagaagtcccagagagctgctgggtttagtcttccttggaatcctgaagtagtagttctaataccactgaagaaataccttaggaatggaatagatgggaaaagtgaaagcttccttcttccaggtccttttatgtgcactgctatcaggagatgtggcccagattcaggatggatcctctacctcaaataatccaaccaagacaagatcctgacagatgtgcccagctacttgggttttagttaattccagatgtagataatggtgatgactagccatcagatgtgaagagtgatcaaaggacacacctgatgttggcccctagactccccatgcatgtggacaatatccatgtgcacacagccagaaatataccataccttctctcacacaaaccagtcagtaaataaataaatacaaaataaagaaaaaggaaaaaaattatttaacctagctggacctaaaagttcacactttaaacccagcacttaggaagcagagagaggccaatacctgtgaattcaaaaccagcttgatctacacagcaagttctaacccatccaggactacatagtgagtccctctctcaaaaaaacaaaagaaaacaaaaaaatgatttaaccttacaagatgttctagtttatcccttactggggatctaacccacagcctcaggaaacctatacaataaacaaagcaaaggcttgtttttttaaggacattgttccctaggggcaggaaacatgctttgagacagattactaagagacaaatacataaagcatcataggaaaattaaagctataggaatgtgaactctgaaaaaatcagagacttacccttgtgcatgtggtaggagggcaaaaactcagataaaggagtgtttccaaatagccaagtgggctgtcattcacctggctccgcttcccaagtactggaattacaggcgtgtatagtcacagaaggcttactttctctctctctctctctctctctctctctctctctctctctctctctctctctctctcactctattgtttttcaagacagggtttctctatgtagctttggctgtcttggaactcactctgtaagccaggctgacctcaaactcacaaggatctgcctgccgctgcctcctgagtgctgggattaaaaaatatgctccaccacaggcctgcatcttctttattttttgaaattattttacttttttaatcattgcgctaaagaggcagacgttgttggatctctatgagttcaaggctggtctatatagcaaactcgaggctagccaatgtgatacagtgaggcccagtttaaggagaaaaactattctatttatatgaatattttacctgcatgcatgtctgtgtactaagtgtgtgctgggtgccctcagaggcctggggagatcattagatcccttggaactgggagttacaaatggtcataagacatgtgagtgctaagagcccgcaaatcatcaggcccattaccagtgctcttaaccactgagccaattgtgcaatcccaggtaaatacaaaatagaatctttttttgaagtttttttaaaaaagattttgtttattaattatatatacagtcttctgtctttgtactaccagagggtaccatatctcattcaaggtggttgtgagccaccatgtggttgctgggaattgaactcagggcctctggaagagcagtcagtgctcttaaccactgagccatctctctagtccaacaatctttaaaaaaagaaaagttactggaaggtggtggctgacacctttaatcccagcacttgggaggcagaagcaggtggatctctgtgagatcgaggccagcctggtctacacagcaagttccaggacatgctctagctacatgctcctgtcttggaaaaaaaaaaagaaaagaaaaaagaaaaagaaaagttagctgggcagtattggcacagcacttggaaggcagaggtagttggttctgtaggaagaggccagcctgatctacagagctagttccaagatagccagggctacaccaagcaaccctatcttgaaaaaacaaagtaaataagtaaggaagaaaaatcaaaaaagaaagaaagaaaagttagaaagctgggtgtggtgacctatgccattaatcctatgcaattagtaggcagaggcaggtatagtttgggaccagtctggtctatatagtgagtttcaagacaactagagctgtataatagatcctatctaaaaaaaaaaaaaatgggggtggggggtgaagagatatgtgcaggcaaaacatccaaacacataaatatgaaaagaaagaaactttaagaatgaccatcatagccaggtggtggtggtggcacagcctttaatcccagcactcaggaggcagaggcaggtgagtctctgtgagtttgaggccagcctggcctacagagggagttctagaacagccaggggtgtacagagaaaccctgtcccaaaaaaacaaacaactaaaaagaatgattatcattagtggaattgtttgttgcagcattgttaaacatctgaaataaagtaaatggcccttctttgcttccttttctttctgtatatttgtttgttctgagacttggtctcttttacataggcctggctatcctgaaactcaccatgtagaccaggctggccctgaactttcagagactcacctgcctctgcctctgccttctgagtgctgagattaaagatgcatgctactacactcagctttaaaccttttttaaaaatatttattttaaaaataatttatttaactttatgtgtattggtgtcagatcctctggaactggagttataaaatgcaatgtgggtgttgggaattgaaccctggtcctctggaagagcagccagtactcttaaccactgagccatctctccagaccctaatacttactttttaaaaaatatacttaatttgtattttatacatttggttagttggtttgtttattctattgtttcatgtgttttctttttatgtgtatggccgtttagcctgcatgtatgtctgtacatcacagacatgcctgatatcttcatagggcaaaacaggacattagatttccaggggctggaattaccgacagtttcgaatcttcgaacccaggtcctctggaagagcagccagtgctttcaacctctgaaccatctctctaggcccatggtttcttatatttttatttatttatttatttatttttgagacaatcaggcctggaactcactatgtagaccagtctggctttgaacagagctctacttgcctgtccccctagtgctgggattagagagacctgtaacaaaaacagatggatctatgtgagttggaggccagcctggtctacagaatgagtgccagaacagactccaaagctacacagagaaatcctgtcttgaaaaaacaaaaacaaaaaattgtatatagagagagacctgtaacactgcactctgccttagggggcatacatagtttgtgctcttgaagtagtctgcgtagacttactctttttagtgactaggccaaaaatgtttttttcttccttgtgctcccctacttagaatattgccaaatgctggaaatataatgactgcacttagttttcctcatcctcacttagggattagttaaggcctgaagaactcagaaactatccatcaaagtcagtctggaaggacctcagggtggggccaaaactcaggttgcctggggccaggccttgtggagttgaggctctgggagctctagtctttgtggttctagcttcctgagttctcatgcggtctgacagcagagctcccttctgggtatgttgttgggtgttgggctgatatgatgagtatgtatgtatgtatgtatgtatgtatgtatgtaggtatgtatttgagacagggtttctctgtattactttggaggttgtcctggaactcactttgtagatcaggctggcctgactgccttctgcgtgctaggaattaagtatgtgacttaccctttgtagagttatcttagatatgctatctcaaaatcaagtaggaaaacaaaagatcatctggggctagagagagagatcgtttagtagttaggaacatttgttactcttccacagggtctcagttcaattctgaggatctacatgggactaatagccactggtgaccacagctccaggcaatgtgatgccctcttctggtctccactggtacagcatgcacacggggcacaaatatacatgtgggtgagacaccaatatattaaatcaaaataaatattttttacaattttaagaagaatttgcaatttgtttttctcctattattagttgggcaaggataatgattattagtatatgaatgtgtgattgctggtgccagggcctgtaagcggagtttctcccaaataaccattcagagacttattattaattataaatgctcagtcaatagctcagactggttactagattgcttttacattttaaattagccttcttttcttctttgtttctttctttcttttttttggtttttagagatagaatttctctgtgtaactgtcctggctgtccttgaacttgctttgtagacaaggctggcctcaaactcagagtctctgcctcccaatgctgggattaaaggcgtgtgacaccactgccgggtccctaatatattttttaaaaatgccttggtttataactttctttgttctgttgctatgaaacaccatgaaactacttccatgaagtagttaatttaaatctgtgttttgcccagggcataatcactcacactttggttccaaaaattctctcttacttcctttgacttgagagctgtttttgtgtggacaatctcagtactccaggggcaagatatgtgaattactgtgagttcaaggttaaccttttctatgtactgagttccagattagccagggatacacactgagactgtttttaaacaaacatgaaaggaaaatagaacgacacacagtgtgggtagataagcaaaggcacaggacacagaagggtaattgataggttcagtagcatagagaagtgatgtgattagacttataatttatgaagcacaagtttgggccgggagttggtggcacacacctttaatcccagcactcgggaggcagaggcaggcggatcgctgtgagttcgaggccagcctggtctccagagtaagtgccaggacaggctccaaagctacacagatcaaccctgtctcgaaaaatcaaaaaataaataaataaataaataaataaaaaataaaaaaataaataaataaataaaaaataaaaaaataaaaagaagcacaagtttggttgcttccagtgtcaagtcatgactgcccctggaaacagcaattttaacacttctggttggcacttgctgagtccccctgtgaaaacctctcttttgttgtggctgcatctttgaccttggtccctagagacaaaatacagcccccccccccccccccccccccccccccccccccccacacacactccttgggatgagagcaaagacagaggtaagaaggcgcagtcgaggacttggaagaggcggagcacagagggcagactggatgtgtgagaatgagaaagcctggtgacaatcgagcttgcagacttagctcttcttctggagaggggaactaggcgtttgaaaagccctcgcgcgtgaaggacggattgcaagaggaaagtaacgagctgtaaagaccacggtcttcgtggagaccagtgacagaaggctggaggaaagtgggtgacttccagaggcattaagttaggaggcgaattaggacggcagatgggcagcatcccggccccggtttctagtgacctcagcggtcacgggtgagtgcggactcggtgttcccgcgtcagggaggtgggcgtggcctgctcgcgctgtcgtcccggtgaccggacggggcggggcccggggcggggccgcccggccgctgcgtcactcgatggtggcgatggtgcgtgtgtgtagggggcgggggatacgctgggcgcgtccccggggtcacgtggtgcgcagcgcgcacagtccttctgtcggttggtcctggagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttgcccgcgggagtgacggccaccgcggccaatcagcgcggcccgagggggctgggctgcgaggtgcgggcccggggcgcggaacagggcagtgggggtggggaggggtgctggagctgcaccccctgcttggcctgtgagattagggcgcagcctacactgctgcctctgtcgcgggaacacgttttcgtgcagtgcctttcttatcctgctctgggaagcacaccctttcctcaagaccctgtatatgggagtgtcctttctctatagttttgaaaatctgggcgtcgctccccttccttaaactctagtcctgggattttctcagtttctagccatccctaagaacggactgaaggcattctcgcttctctttgctcctcaatactgagggaacactcccatattcaaacgtaattaacagttctcctttttcagtttggggttcagtctgctgataggtccttgagaagtcaggtctgtaaccaaagttttgcagtactttattatatcccacaactctgaggaaaggaatccttcttttcaggccccaaatctggcatgcttcagtagtgaatttgagggccagtttttgtttttgttttgttttgttgttttgttttgtactttggtctacggtgagcatctcttttcgggttctagtccaatcctgatgcttatggctcatagtttccagtttcatctataagaggattcgctgacttgtccttaagtctgtccttggggttgtatttttttcttgtgttcgccaagcttacttgtttctgggggagactggttttcctatctgagagtgtgtttgctttctgggtctctttagggtttgagatgcacctcttttaggaggacacataccaccgtggggggtgcagcagggctgggcacacctttctcttgaatcctcccattcctagatggggtagttcttgagcacccctcacccaccggttttccaccttgtcctgttttctaattgaaaaaattatttatttatttggtgtgtgccataacatgtatgtggcaataacaggacaacttgaaggatgttatctctctgcttccacttcgtgggttctaggaatgaaactcaggtggtcacttgtggctgcaagtgttgagccatccagctagccagtcctcctgttttgagaccaggtcttgctgtgtagctctccaggaaatagtgtgaagtcccagctggctttaaattcatgatcctcctgccttggcaccggagctgagattacaggtgctctttcctatcccctttcttcttaagcttttctgccatgcaagatagtttcactcttgggtttccttccccctttagaaccacattccccttcatgtgctctcccaggctctgtagtgtgtctctttggtcttccttcctctgttgaatgtgtatctgcagaacactttctgtattgatgccctcctcccacagggcagttcttttagtcaccctgcccgagcctttctttcttgacagaatccccttccacacccatgagactttcattgttcattgtgaggccctgtctcacgaagtagttcaggttatcctggaacttactgggttgtctaagttggctttgaacccatgatccccctgcctcagcctcacaagtgctggggattaccggccagaactccggtggcgtctgagttgtgtggtgcactcctttagtcccaatgcaagcaggagatctctgagttggaggccagcctgatctgcagagctagttccaggacattcagggctacacgaaaccctgtcttgaaaagccccccaaaagaactaccatgcttggctcacatttatatatatgtagtttatctttctgcaaataggaattctcttttggttcactgtttgtccaggcatttttctggtttctggttcctgttggacactgttctgcttatctggtgatgataatgtttctcctttctcttcctctgtgttggagatggccgtaagaccagggctgcttgacctgttgctacagtcaaaatataaagaaatccccttgtaatttttgattattcttagaactcttagtcctccgatgctttacttcctgtaagtttctggtgaagctcttaatagtttttgtggatttgatcccagcaatcatggctggaggattgttgcaaatttgagggctgcctggtccatatgatgagctccaggctagctagggacttatagcaagagcctatctgaaaccaacagatctgattaggtaggctctattcctttacttccctttccctcaagccgtgcacacacacacgcacgcacgcacgcacgcacgcacgcacgcacgcacacacacactgtcttctttttccctcaagacagggtttctctgtgtaggcttgtctatcttggagctcactctgtaggctagtctgacctcaaactcatagagattgcctgaggcctgggatcaaaggtgtgcaccaccactgcccagcctcttttttaaacttccctgttctgggttggggcttcaagagatttttctactaatgtatgccttctagcccataaactaccttccattagttctctgtatcaagcaaaaaagtcatatgggctcagtgtggattatttgcctgccatgtgtggagggtcttgatttgattcttagcatgaaaaactgtggcagcttgatttggtggcagacacctttaatctcagtacttagggggcagaggcaggcagatctctgtgagtttgaagccagcctgctctacgtagtgagttctagaacagccagggctatttagagactgccttaaaaataaatgaatgaaaagaaagaaagaaaaaaaaactgtatgtctttctctccttcatcttgaatatctgaatatctgtctgtcttttctcccaacccccatttttaaaaaaatcttcaaacacctgggacatcttgtcttaatagatcctcactgctaatatttctctttccctctccagagttttgcatagggcttttcagtcttgaacccctgattcatttctccacagctggagtttcaaatgctgaggggataatgactcctctgacctttcttccttttgggaagtacttgaatgtgcagctgaaggaggcatgaggcagggggaagggagtttggctatgagaagctataccagtaggacagggcaggaatatagcatttcatgacccaagtactgaatctcatttggaaactggacatttgccaggcacctgcttcctagggatgctggaggatttaatggtaccctgggaacctgtaggaattaatggggttttcggggaggtgccccaactcagtgtgagaacgtgaataaaattgaccatcattatgttttggaacagataagctgcctcagatttttttgttcactaaagtactagaactaagttgtgttatttcaagaagggaaataaatcccttgttcagtaccacatttatttatttatttagatttttggaggcagggtttctctgtgtaacagccctagctgtcctggaactagctctatagaccaggctggcctcggactcacctgcttctgcctcccaggtgctgggattaaaggcttgggccaccactgcctagcacatactacatttctttaaaaaaaaaaaaaagaaaaggtggggtggggtggggtggggaggtctgtttgattagtacctaataaaatatgatctgctgaagtgaacaggtagtttgtctctttatttggctcttgctgctctatctgtgtagtgctgtaagcactcccttgaagggccctacattcctgctcctcatcctgaatgtgacttctaatgacctgcttgtcttgggtctgtatatattccactctagtttttgggtggtgtaaagatagggaactacacattgagtagccagattcccatatacagctgaagagcgaatcctcagtgaaaacaaaactgattgttaacaaatgctggggtattgttctccattttctctttgtccagacacacaggtcaaagcttgtacaatgtaccggatttcttttttctttctttttggtttttcaagacaaggtttctctgtgtagcattgaccatcctggaactcattttgtagaacgggctggctttgaactcacagagatccatctgcctctctgcttctggagtgctgggattaagggagtgtgccaccactactggcccaatttctttttttttttttccctccctatttttagcaaaaagaaaaaaaatcattttatgtgtttgcctgcatgtatatgtctgcactatgtgcgtgcatgcctagtgcccacagaggtcaaaagagggagttggatcccctggaactggttatagtcagttgtgagttgctttgtgactgccagaaattaactggggtcctctgaaagagcagcagtactcttcttttttttttttaaaggaggtcaagtgttttatttattttttagagatttatttatttttatttatttatttattatgatttattatgtgtacagtgttctgtctgtatgtcgcctgcaggccaggggagggcaccagatctcattacagatggttgtgagctaccacgggttgctgggaattgaactcaggacctttggaagaacaagcagtgagtgttcttaaccactgagccatctctccagcccgcagccagtactcttaacctgtgagccatctatccagtccagaacccctcccccgactttttgagatagtttgctgtttgtagctccaggctgtcttcctcgtcgtcgtcttttttttttttttttttttttggttttttggttttttgagacagggtttctctgtggctttggaggctgtcctggaactaactcttgtaagccaggctggtctcgaactcccagagatccacctgcctttgcctcccgagtgctgggattaaaggcgtgggctaccaacgtccggtcgttttttattttgtttttttttagatttttttaataatgtatacaacattctgcttccatgtatatctgcacaccagaagagggcaccagatctcataacagatggttgtgagccaccctgtggttgctgggaattgaactcaggacctctggaagagcagtcagtgctcttaacttctgagccatctctccagccccaaggctgtcttcttacctcatagtctggtactgtagatagttgccactgtttctagctaacctttagcttttttaagctgtctgtaaaatttactggtttctctgtatattgccagatttaagtgcttaaatatatgttgcttaaaggtgtgttttgcctggtgttggtggtgcacgccttttatcccagcacttaggaggtagaggcaggcagatctctgagttcgagggcagcctggtctacagagtgagtgcctggataggctcgaaaccctgtctctcgaaaaatgaaaaaagaaaaagaaagaaaaaaagggaaaaaaaggtgaacttttttttttttgccttgggtatgggtttgaaccagggtgttgtacatttaagacaggtgctcttctgctgagctcctgtaccccaaggtctgatgggtaatttttgacatgaaataattctagtaagtattgagtagccagcttgtttctgactcctctcttgttactgtgagaagggaatcaggataccccacatcaagccactggagtttctagagttagttctctttggttttctggctcttcagatggacatgagaaggtccagattgcagctaggtgcttggccttggatggaagctgtcggacatctgtaaatgctctagaagatagtcctggggagctggtggcatttttgatgagcttttagtttgtgatactctctccttgtgttatagggggtatttctttcctttatattttttaaagctaggttctcttatatagcctagactggctttgaactcctcctgctcaaactcccaagtgttggaattctaggcatctgctacttatgcccagctctcactgggcttttccactctgaatctcttaaatcattcattcctgtttgcctgttagctttcatggccctttcccaatgtgatcctactccaggtcttgatcatgaggaacctgaatgttttgtgtccctgatcttcccctaaaccctccattcctcacacaaatggcagattattgtcagtgacagatttgatctggatctggcactggtcccagctcttatgggcacatgtaacctcaggcaaatcactttgtgctcttatggctaggcctcattctccccagctgaatactgagcagttgactatttcaaggtccacccctcacagattctgcagggaccttgtttagaaacccagttgcctgcaggagcgcctagtagctggtctgatttccttcacgtgcttcagctggcagactgccaatggttttcttgtcccaagtcacttttgctggcactgtctcctttctagccaaacagccagcttgtcttcacgcccaatgtcaacattcttctgcctctgtgttctcttgtcagttgtgggctgtatttcattcagaactacttcaggttctcaaagaagtctgacttgagttttccattcaatattagctgcttgtctgcatcactaagagagcagctgtttgttttttaggctgtatttcaaatataatcatttacttgttaatgcttttattttttaaaatgatttattttgattttttagtgttttacctgcatgtatatctgtatgaagttgtttttgtttttgttttttgtttttcaagacagggtttctctgtgtagctttggagtctatcctggcactcgctctggagaccaggctggcctcgaactcacagcaatccgcctgcctctctctcccgagtgctgggattaaaggtgcagcctgtatgtagttgtttaatctcctggaactggaattacagacagttgttagctgctatgtagttgctgcgaatttaacctgggtcctctggaagagcagccaatttgtgtgtgtatgtgaaaagtatgtgtgtgtatgtgtgcatttttggaagccaaagttcttcaatcacttagacattttatattcattcatttatttagagacaagattttactatgtaaatcagacctcaaactcacagagatcctacttcatcttgcctggtacacccctcatgccactgcggactccaccccccacccccccgcaaaaaaattcattcattcattcatttatttatttatttttggtttttagagacagtgtttctctgtgtagctttggatcctgtcctggaagttgctctgtagcctagactggcctcaaactcagagatccgacttcctttgcctaccaagtgctgggattaaaggcctgtgccaccactgccctgcttaaaaaattttttttgagactgggtcttaccacatagatctggctgtcctggaattcacagagatccacctgcttctgcctcccgagtgctgggattaaaaacaaatttatttactttagatttttttcttttacccacctcatttatttgttatttttcaatcttaattaaaagcctttttttgtgtgtgtttttgccttaatgaatgtatacttcgtgaatgcagtgtcctctgaggccagaagagggtgtgggattcccttggaactagagttacagagagttgggagctgcctcgtgggtgctggggattgaacccaggttctctggaagagcagtgctcctaatcactgagccatttctccagccccatccctgttggttcttgactaacaatgaggtaacctaatagctttgttggattcttgcctaggtctctccagttggaccttggttatttggccaaatggaactaatgggctttcagaaatcttgcaaaaatttagagagtctggtattagtcacccagtgtaaataggatggttgtgggaaagagaggtggtgctggagtcagtggtctttggaaaaggactcagaggtgttgtttggggaagggtttaaaatggggcctttattccatgaaggaacataatcctaggaattcaggccaactcctaggtgtgtgtcctaggggagtgcatttgaatgttttttttctagtaggaacctgtgattttagaggtctctcccaaatgaaaaagatctaatctttaattccattacacctttaatactagcactcagaggcaggagcatctctgaatttgaggccagtctggtctacacagggagttccaggccaggtgagactgcatagtgagaccctgcctttttgttttgttttgttttgagacagtgtttctgtgtggctttggaggctgtcctggaattaggtcttgtagacgaggctggtcttgaactcacagatatctgcctgcttctgcctcccgagtgctaggattaaaggcgccagcacgcctggcgaccctgtcttaaaaagagagtgggtgtgggtgtctacagctgggtggattgatttacctttctggcttctgttggtgcacagatgattgaaataccaaggttgtggaagtctgtcatagaaatgtgggtacttaaatcctgctgcctctaccaggagcaagggttgcaggatgctaccatgcctgactcttcattttcaaaaaaggaaacatagcagttccttatcgttagtatcctaaagatctttttgttgttgtttgttttttgagacagggtttctctgtgtaacagcctggctttcctggaactcgatcagtaaaccaggctggcctagaactcatagagatccacctgcctctgcctggctcattttatttttttaaataacacacaattctatttgcatgtatgtgggaccatacactataacatgagcacacactcaaagaaaagtaactgtccctcttccagtagccatcaattgccacagctcctcagctaagtggaagactggcttgatcttatgcagctctactgtaggtaaccatagctgctgtggctttatgtgtgcaacagctatgtcctatccaaaggacagcagttcccagcagccctccccagcctctggctcttattctttccaccccctcttccaagatgttccttgggggatggggattactatagattctcagcacgttgtcagttttgagtccctgaattaaccactgctcactgtaaaaagaagcttgtctgtgcaggttgagaatagcacaaatctgtgagtataaacctaaacatctaggaggtgcttgaccatatatctgaccatttagcaaagcaatagtagctcccccagggcctttaagcacttgagccagggttttttgacccggtttccaatatcaaaaggcctttttaaagaaagctatatagtggcatgaagtcctacttctcagatttcagcttttctgcttagccaggtgccatatggccttttcctaccttgtaggttgtgggtcattgctgcctgtttctctgcattgttggaaatgggatttttgtcaaggatttggtatgtggcaaaaactgaacagatgttatctaattcctggaattaatagttaaggaaggcctgggataaaagttaatatttaaagcgtaagagaattagttgtcactaattgtggtggtggtgcacacattaagtcccaggcagatgtaggcagatctgtgagtttgagcccagcctggtctacagagctagttccaggacagacaggaatacacagagaaactctatcttgaaaaaacaaatagttgaatattaaataatgtgtttttaacattctataagcaacaaaagggatgcttttttcaaggaaaaacttagtttagctgtgttttcctatgactttcagaaagaacacacatgtacccaggtaatggtggttcatgcccatgatcccaatacttaggaggaggctaaggcagaaggattacttcaggagctaacctggactacagagtaaatttttatttcaaaaaaaggaaatagggggagaaaagaaaaaagaatctacacaaaactcactacaagcctggccaaaggcaggtagatttctgtgagttcaaaaccagcctggtctatatagcaagttccaggctagccagggccacatagtgatccctgtctagaaataaaccaaaaagacaaaaaccaaccaaccaaccaaacaaacaaacaaaaaaccctgaaaaatagaacagcaactccccccccccaaaaaaaacccaaaacaaaacccaaaaccaagcctcacttgagacctctactcttcagtctctagacaatggaggtacttacaggctgaggtccccagggcctgtgaaaagtagttaaaaattttgtcagacccttggagaaaataatagcctgtcttcaggtgctattttttccttaggttttgccacctccctgtgtttccaaagagtactatttttttttttaaagattttatttatttattatgtatacaacattctgcttctgtgtatatttgcacaccagaagagggcaccagatctcataacggatggttgtgagccaccatgtggttgctgggaattgaactcaggacctctagacagcagacagtgctcttaacctctgagccatctctccagctcgagtattattaataattaatagttcatatgtttttgtatgcagagcattttttatttttgtttttttattttatttttttgcttttcagggttttagcacaatgatgtcctttaatcctgcataggatggtactgacattcttccactttcctagtgaggaagctgaggttaccacctaacaagtgtatgtcacataaggtcactgcctgttagactggggtgcccatcaagagctccttagcttctagaagagttcagctgcaacagtgtctcagtcaactgtcatgagaagaggatacagaactgatgtcctgttgagaggtactgatggctgtgcccaggcctaatggatgagggcggggcttttctgcaaaggttctacaagcagtctggattggtagggctaagggctgcaagattagtagccttgacagtttattgtgagccaagctcttggacaccctgtgaaggtaagcactagctgctgatcctcaatgttataggggaggagcctcagtctccgcacgaaatgacttgttcaacattttgtgatcccagcctaggccaccctgatgcagagtcctggcttagattccctgcttccctcctttccagctcccgtctttagagacccccatttggcttggcagtacagttgttacctggaatcagaccacctgttttccagatactgtccttgtgtgctcaaagctgtcctcacacagaatctcctgcttccccctctcaggttcttaagtgcaaggattataggtgtataccaccatgccctccctgcttgtgtgtttgtggggcatgtatacatgtttgtgtgtgggtttatatataatcacttccctcaggcggtagaggcagcaggaaggtccaggtccaaggtcatcctcagctacatgagatcccatctaaaaaagaaaaagaaaaaattaccaaaataggggtggatccttaattgggtaccctttggcaaaggagaaacctttaagtagggcctgcagaatggtgaccaaccagaaatgaaataatactggatgtgtaatcttgcccacttgaaaagctgaggcaggagtttggctatagaataagaccatgtcgaaaaaaagaaagaaaaacacaagaagaaaggtgttcagggcattgcttgtgtcaggctggaggccttccttccacagtggtggacagggaggaggagtgattgtgagggtaagatgttcctttagtgaggctgaggaataggccagaagtcatagagaaaaagtattccagggaaaaacctgggcattaggctctcccactgactgtggaaagttccactgattcagccagctcattctcagtaataggaaggagtaaactcaacccatttagttatggaagataagcttggggcctcagagaatgcagttttgaatatggctttgaaaacagtgtttcactgtataactcaggttacctcaaacttggggcagccctctttgtatcagagtgtctccttattttatttatctgtgtgtgtgtgtgtgtgtgtgtgtgtgtgtgtgtgtgtgtgtgtgtgtgtgtgcgtgtgtgtgtgggtgtggggcggaggaggtgggttggtggtgtggcgtgtgctgtggcacctgtggcgatcaaagaacatctttttttttctttgcttttttccaagatagggtttctcttgaactcacagagatccacctgcctctgtttcccaagttctgggactaaaggcatgggtcatcatctggccagatgacaacttttatagtgtcagttttctccttccatcttttattttattttttattttttgagacagggtttctctgtagctttggagactgtcctggaactagctcttgtaaccaggctggtttcaaactcacagaaacccgtctgcctctgcctcctgagtgctgggacaaaaggcgtgtgacaccaacgcccgacaagaaagatacttatataaaagaaagtcttttgttttaatttatttatttcttatgtacaataatctgcttccatgtatatctgcacaccagaagagggcaccagatctcataacggatggttgtgaaccaccatgtggttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagagagagagagagagagagagagagagagagagagagagagagatggggagatgacttagatgaatgagcagttaagagcactggcccttcttctggaggacctggattagattctgacttagatgactgagcagttaagagcactggcccttcttctggaggacctggattagattcccagcacccatatggaggttcacaaccatctctaactgcagttcctggggacccaactcttcttctgcaggcaccagacacgcatgtggtgcacagacaatcatgtaggcaaaatgtccatacacataaaacaaaaaacaaccttcataaaaccaaaccaaactgtccctcccctcctagtcttcatctctctatcctgtcagtctaatagacttgtagtgtgagctaggagaaggccctgcttgaaacacttgatgttgggataaactacggatttatttatttgtagcacagatgtgcctcagatttactgggttgtgcgggatgatctcagatatctgtgtccacctgttgggcttgcttcatggagtctggcatttattttatctcgttaaggttctgggaattgcactcacagctcctgcatgctaaagcacacatcctgtgccgtgtcccccagtcctgtgatagacattttaaaggaccttagagacttttctggtctgatcctcacagatcccaagatagaggccaataggctgtatgatagataacaggaagaaaggcctgaggaggtagctggtaaacagaactggagtggtaattaggggtctgtggacagtggtgcccacttccagcacttgggaggcagaggtaagcagtttacaaagtgagttccaggccagccagggctgcccaataagaccccacctaagaaaaaaactaaacaactctgggatgagcctcttgctatagagtgtcctagaatgttctgaatttgccttctctgtgtgtgggagcttcccaccacttgcctctgactcccacatggctactgtggcacatgggcccacacatacacatgcacatgaaataaatgaaagtgtaataaaaattttaaatggaaaaatactctcttgttcctaaatgtgagcattatttctaaatttctccagaactgggtgtaggaggctcttggtttcttgtcacagatgaatcttttgtattctgggttgtggtcttctggtggaagtgtcagagtctgggattccaagcgtcttcacagcatgctctgccttctaccttgaggtttgaaagatgaccgctgctagagtcccagctatgttccactttcccctccacaggggccgcattagcttggtcctttctgaaaacttaagtatttctgcttgttgtaaaaggtgtggtaatgctagcacagcctttgaaaggcttcagtggctttatcttcctttattcaaaatttgcctctatctaaaggcgtgaatacaaacaagcacagccatgtctgcttcttttgataacagggatttctcatgcttggatattttgttgttacattcatgttgatttttatttctggttatgtgtgtcccatgtgtgtagatacccacagaagccagaaggcattagatttcctgaggctggaggctgttgtgagctgtccggtgtaggtgctgggaactgaactcagatcctctggaggagtaacgggtgcccttcgttgctgagactcctctccatctctgccttgtatctttataaccttatgtaatctgggaatgcctgatgcttcagcttttctgcacttatatcttctcagtatcatgggaacaagaaatttagtcttaattgtattacctggttttgaaggtccagtaacacagtataagtataatattctttaaaattttatatacctatgtgaaggtcagggggaaagcttgtgggagctttctaccgtatgagttttagggattgaactcaggtcttcaggcttactggcaagtttacctagagagacatgtttccagtccacaaatgaattcttgcaattaaaaatttgtgcagcaacaacacaaaacaaaaaaaatttttgtatgatatcctagtcatgatggctcatgcctgtaatctcagcacttgagagactgaggcagaaagattgctgtgagtttgagaccagattgtctatatagacatagtgagttccagaccagtttgggctacagggagaccctgtccctgaaaatataaaattgttttgatttgcatttcctttaacttagggtgcttatgtggacatggacctttgtgtctccccttgtcagtcagtataatctgacagctcttgcattttgcccatttttggcatgcctttttacctttgtccttagttatagcactccttgttaataaaggaagttgcctctttgtcctaatgagctatagttatttgtccctttgaactgtgctccaccatgtgtattaaagctctcattactgttgactcagggcattgacagagcactgtgtctaagtaaacacattgggcttccggtctcctttgggccagtggattcctgtttagagtttgaatgttaggagtattttgaagttctgccagtcttgagagtagaatcctatagatctcatcaggcttttttattttttggtttttcaagacagggtttctgaatagctatggagctagtcctggaactctctctgtagaccaggtttgtcttgaactcacagatctgtctgtctttgtcctctgagtgctgggattaaaggcaagtgccaccaccactgggcagaaattgtttacatttaatcctttttgtgtgttttctgtgtttgtgtatatttaagtgtgaacatcataggacgactctctggaatgtgttttctgctgtccatccgagtccactgagccatctcaccatctcatgtgagacttttgtaaagattaaaatttaatattgtttgagctgggacggtactctgtagccctagctgacctggaacttgatatgtagaccaggtgtgcctggaactcacagagatcccttggctctgcctccccagtgctggaattacaggtgtttaccaccatacctggcccttagcagttcaacaccatggagactattttcaggagccacaggaaataatttggtcatcttcactcatcagttcctgcttcatgcctatattatttgtttattttttctctgagacagggtttcacaatgtagtcttggttggcattaaactttcagtgatcctcctgcctctgcctttcatgctctttgattccacgcatgtgttaccacatcaggcttgattgattgcttacactctgcagtgcgaattgaatacaggaccttgtgcttgctgggcaaattcttttctgcggagccgactccccagcactatagagttcatttagtcaagtctggcctggaattggagcttgaaatgtagccgaggataaccttgaactcttttattgtacttactctttttgaaacagaataagtcagtttctgtgtaactctggctagtttgaaatttgcagatagcagatatcagcctgcctctgtctctgcctctggagtgctgggattgaagttcagttctactggactcatgatagaccaggctggcctcatattctttgtgtttcttctgttttagcttcttgagaactggaattgtaggtgtgtgtcataatgcttggccttccttttgtttttaaaggattaatttttatgtgtgtatgtatgctggtgcccatggaagccgggcattgggatctcttggatctggggatacaggtggttgtgatctgtttgatgttgggtactgaacttttggtactctggaaaaaaaagtaagaggccttaatcaggcctccttccttttatagttatttagtttttttttttttttttttttttttcttttttttctttttttcttttttcaaggcagggtttctctgtgtaacagccccacaaaactcactctgtagactaggccagcttcaaactctaagaggttggcctgcctctgcttctcaagtgcctggctttacttaagtggtttttgagatagggttctctgtatagacctgtctgttctagaactcactatgtgattataagtgctcagccaatagatcaggcttgtttctctctaactcttacattttcaattaacctgtatttttaatctatgctttgccatgtggcttggtaccttttctcagtacagcatgtctctcttgtctttgcatgtgctggcaactccagactccaccttccttcttcccagaattctcctagtctggctcccctgcccaatctcttcctggacagctattggacagtcattttctttattaaatgattcatagcaacatgtattcacacagtgtaaaggaatattcaacagtatactaccatgctgagctttatttatttacttattttgagactgcattatttatatttatttgggtctcactgtgtagtaatggctggcctggaacacacagggagagacctgcctgcctcttcttctggagtgttggattaaaggcacgcaccaccctgatttattccccccctcttccctttttttgtgtgtgctggatgggacttagggccttgtatttgctagccaagcgctctactacttgctgggtgcacatgcagctctagaactctgttttttccttgttctttttatggtaaggtctcatgtagctcaggctggctacaaactccctaggtaaaaggatgactatgtactttttttttttttaaagcagaaagaacagatagagtgtattttatgtgtattgatgttttgtctgaatgtatatctatgtaatattgtgtgtgcgctgcagaacccagaacagggcgttaggttctctgaaacccaagttatagaaggttgtgagctatcatgtgggtactggaattgaacccaggtcctctgaaagaacagctattggccttaaccactgagccatctctccagcctaggaacagatttataaaaaaaaataaataaataaaaaataaggaaacctcttgatgtgaaatgttgacaagggaggaataccaggcctagaacttctgatcctttgcctctacttgcttagattatagggagggccaccatgcctggctttgttcaatgctggggatccttgtgcgccctaggcaagtactctaccaactcagccctacaactttttgtctacttttccaaaagtagggttggaggacaacagtgtgtcttttgttgttgttcttgttttttgtttttcttgctttgttgttcagagttggcatcaactccctggggctcagggatcctctttcagcttctaagtcttggctgcatctcagctcatatctacgtcctttctagcactcaactttttatagcagttacagcttgaactgactcctgtttattggctacatattaatatgaaggctcctcgagggtaaggattgttcatctctttgggtcttgactaagtcatttctgaacaaatatttgttgaatgtgtcatcgaggttgagctacatcatgagaggagagcagttattttttggagctctgagggatgaacttcataggggagcccttggtaagccttgctgagaggggcctctgaaatttcagagatcacaggcacagtagaggagtgctgctggtggggacaccggataggaggggaggcaccagagagggtgctgacagggtcatggagcttggtgttttgaataatgcctgcttgtttttttatgtgtggtggtgatgctacacgctgggcagactttcccaagtttcataaatatttaattggctttttcaggagaataaaagcagccccgttgatgactgaaaatgacaaagcatccacctaacagacgaggaatcagctttgaagtgggagcccagttggaagctcgggaccgtttaaagaactggtacttttatatttttttctaattaaagcactttagggagggagtctcaccagcacctatagagtggtgctgctgtcctgttttccggcttcttggaagatgaagggaaacaagtttagaatataggcctgttttttctctttgggtcacatttgtttctccttttcctgtttgatggagttatgttaaagcggagcaggggttaccctgggaaggaaagcgttctcactcttggttgcctgtttgaaagaagagcagaagtgagatagagatgagtggatggatagacgcaacagcacccatgtcatcacaacctcccctgtttttctgggtgtggcgtaggacgctaagaattgttgaacaggataattagattgagaagctgaggggttgttttgactgcattgctgaattttgcttgttttatgtgaaaaggtttctggtaactatggccgaccttgaattgatagctgagcctccttaatgctgggattacgggtctctgcaactatggctggcttgtgttaattgctttttatcctctggctgtcagatactttgaatgttcatgtcatctataaatgtggtcactggtaatgttggcatctggagaggatattctaagagtcacatattgaatatctggagagcaatcttcaaaactaaacttacctgggtgtggtggtacacacctgtacttcagtagctgggaggctaaggtaggaaggttactgagaactggagcatagcctggcataatgagttcctccaggtcagcataaactacagagtgaaatcctgaccccaaaaatccaagctagccaacggaaattcaggttcagttggtagagtgtttgtctagcatgcacaaagccctgggtttgattcccagcactggataaatcagaggtggagaggtagaggcaggggtgtcagaggttcaaggttatcctacctgctgcatagtgaatttgaggccagctatggttatataagaccctgcctgaaaacaagaagaaaaagaaaaacagaacaactacaaagatagctgtagttgagggcatcctagattttggttatttcgtggtgctccaaaacagttagaagtttcagaaccacaaaccttttgagtttttctaaggaatagcctaaccctgtgatagttatctcagaatagattgagtgatttctgggatatagggaaaggaaaggggaatggcttgggtagaaaactgtgctattaggattaaagaccctggaactagagagtgagtttgataaaatacttgtctggtataggtgaggccctgggttcagtccctagcacctcagaaataaaagaaaatatggtttggttgtatttatactggttgtgaacagaattactgattctataattattttaatgttggtttcagctattttgtattttttgtgtggggggcagtacatgtctgtacatgttttcaagtgcatttgcctatttgcgcatgtatggtagtcattttcctgtgtatgcatgtggaaggaagcattaaatggactcttctatcactgcccatcttgttttttgagacagtcactcagagaacctgactgggcagggaggcaccatgatctgcctgtctctttcccttccccaagcaatgggccctgtacctagtgcttgggattcaaactcaggccctcatagttacatagcaagcactttacccctgaaccattttccagccttgtcagtcaaggggaagtggagattgaacctgtgactttgtgtatattagacaattgtttcttctattcccagcctgtatttctggtttagtttgctttccactcctctgataaacaccacaaccaaaaacaactcaggaaggaaaggctctcgtgtctggatcatagttcacccctgagggaagccaaggccggaacctggaatcaggaactgattgaagcagagatcacagaggaatgctcctagaggcttgctcagtttgttcccttatatactctgggaccatctgccaagggatggcatggcctaagtgggtgggctcttcccacatacattgttaatcaagaacatgcccttacatacttgcttacaggccagtctgactgaaggagacattttctcaggtggtgttcctcttcccagatattgacaaaaaattgaccagcataattttgttttttttgagacagccagtaaattttttaaatttattttttctttttattcctctgtgtgtgtgtgtgtgtgtgtgtgtgtgtgtgtatgtgtgtgtctctgtctgtctgtctgtctaagtttatgtctgtgcacatctgtgcattagtggaggtcagaggacaacttgtggaagattctcctttactgtagaatcagagaaacgcaggtcacaagggatgtagtaagtgcttttatgcattaaaccatcttgctgactgtggttttgacatttttgttcatttgtttgtttgagacagggttgccctagaactcagagatctatctttctctgtctccccagtactggaattaaaggtgttcactaccatttctggctttggtttggattttttttttaaagtgtgcattggtatttttcctgcatttatggctgtgtgagggtgttggatccctggaactggagttgtagacagttatgagctgccatgtgggtgctgggaactgaactcaggtcctctggaagaacggctagtccttttcaccactctctagcctgggttttgacatttattgaaggcctgcttttactgactaggatggtgtatacacctatatttctagcacttagggtaagacaggagtttaaagctaacctgcaatcttatctcaataaacagatagccccaaataaaaatgttactgttagtgttatagtcaaggaatcaagggaatactttttttttttgaaagggtctaactatacagaccagacttgttcttgaactcacagagatctgcctgcctctgcctcctgagtgctgggattactaccccggcaacattttttgttttaaaaatgaaaaaatattaggatacagataaagctaattataaaataatttacctgtcaatcagaatcagtaaatacatttttgtttaatttgcttaaaacattttagaataaaggtcttatcctcctgcttcatcagccttctgaattctgggatttgttactttaaaaaatatattaattttaaaaataagccgggcgttggtggtgcagggcttctctgtagctttggagcctatcctggcactcactctggagaccagactggtttcgaactcaaagagatctgcttgcctctgcctcccgaatgttgggattaaaggcgtgtgccaccaacgcccggcttatttttgaaattttaaaaatatttgtatatgaattcttttggctgcacgtctgcacgtatgtgtctggtgcccaaggaggtcagaggggggtgggatcccttggaactggatttacagagagttgtgagccaccatgtgggtgctgggaatccacgggtcctctggaagaacagccaatgctcttaactgctgagccagctcatttttatgtgtgtatgtgtatgtctaagtgtattgtgtagcacatgtgtggaggagcctttggagatcacaacaggtatgagaagtctgggcagtggtgggtaatcccagcactggggggggggggcagagaatgacagatctctatgagttcgaggacagctttgtctacatagcaagttggaggacaaccagaggtgttacacagagaaaccctgtttcaaaaaacagagaaactaccaccaacaaacagaagaggcactgtgtcccctagaacagttgtgagctgctgtgtggtgctgggacatgaacgtgggttttttcaagagaagtaggtgctcttaaccactgagcaatctctccagctcaggatttgtttaattttgagacatagtccaactggtagctcttggtggcctggaacttatatccttctgcctcaagactcccgagtcctatgattatatgtgtgtgtcagtatacctgcctgaactctctactttgctcctctttcccttattacatttatttatttatttttgggttttttttgagacagggtttctctgtattgttttagaggctgtcgtggaactctctgtagaacaggctggccttgaactcacagagatcctcctgcctctgcctcccaagtgctgggattaaagtcttgtgccaccaacacccggcaaatttttactttttaacatctgtgcaagatgcattctgacagtgctcactggctgggacatttcattgtttgcttagatcattgcttctgaacgccttggtatagatggaggtagttacgctgtgagtatcacagcagtgtttctgccaggttgagtgtgtatgttttaaataagttttagttgtttctttcctttctccctctgctacccaggctggcctaggctagtcactctcggactcatgtttcccatgtgctgggattacaggtgtgaaccataccttaacaacttactaattttgacacatagattcttctttggttttttttgaggccaggtttctctgtagctttgaagcctgtcctggaacttgttctgtagcccaggctggccttgaactcacagagtgctgggactaaagatgtgttccaccactgtctggctagacacatagattcttggcagcacttttactctttcttcccccaggaaaaatgtacatttaacacccagactactcacgagaccgaggtgagaggttggaagttcaatgccaccctaggctacagaggaatctcaaggcagcctgggctgcatatgcatagcaggatccctctctcagaaacaaacaaacccagggaagccagaagagggctgaatgggagagatcatgccttgaatgcttgagctcttggtttaattcccagtacagaaataaagaaagaaagaaagcagggatgtaattggacaaaatttcaggtttactttaaacttttttgttttttgagataggaactcattctgtagccctagctagcctggctaggggtcaattagtagccagaagatgagaatttgataagttcatagagagccatccactagcctctgcctcaagcgctgggattaaaggtgtgcaccaccacgccttggttcatttcatgagctagccagggagacaagacagtagagcaatagctggttcaaggcagtgcacttcatcttaagatctgtttcaggatcaaggcttgtagaccgtcattactatgccagttgaaactggtctgtgtgggaaatctgactgttaccattccaatcttgatttcttagatccagcttggcgatctgggactttattgtgagtgattccattttgatgttgagttcaggcttagtctaaaacaatggcctcctgtaactttgttttagcagaccatttttggcagagtagaaagggagttctcaagacaaagttaccaccagcagagcctcctcttctaaaagtcttgcttattatcagccggcagccagggagagctgtgttggctcagaggtacccatgggattcgtgactagggtcagttactagccagaagatgagaatttgataagtgtgttttcaagtcctctgaaggtaaactatctgccttattcactgatatctcagagctcagggccttgtacatcctaagcacaagccccactactgcgcctatgcctttagggcagagagaaagcaaaaattttcttcaatgctggatggagggtctcatacatgctagaaaatgccctattattgagccatcccccaattcatacttttcctaatattgcagaattagatagcctatttataataaatttcctagcaagctaagggattgtttgttgttttgatttatgtgtgtgtgttgtgcacatgtgtgcatatttgaaggtgtgcctcagtacacgtgtggaggtaagaagacaactcacagggttatttctctcctgccatgtctgtcctggggacccagctcaggtctcaggcttcacaccaagtgctcttagcccactgtgccacctcactagcccctagaaatgaggtaagggggctggagaagtggcacagtgggtactagtacttgctgcttttcctgaggatctgagtttggttcccaaactgagtggctcacaactgcttgtaactcagttcaaggggaccctacccttttctagcctctgtgcatccctgcacctaagtgacatatacttgtacaaacatatatgcatacacataaataaaaatagatcttaaaaatgaatgagggaataaacaagaatcacagaggtaaaaatttctttcccatattacagagtgaaagaaatggtagagctgggacttgaaactgttagtcggactctaaaggcaaaccatgcttccaagtggattcctcttgcctattttctggatatgctactatttgcatagtaaggaaaaaatgggaagcataaaaaataacaagttaattatatttttctttttcttctgtgtcctggaactcattctgtagaccaggctgatcttgaactcagagatttgcctgtctctgcttcccaagtgctgggattaaaggtgcatgccaccacagcccaacttagtcatattttaataaacaaagcaggagtgtagatgggtgttttatgttattagtttttgctatgttgcttatgcagaggcctgggtctccctcatcttagaatgctgcttgttagacaaacagcaatgacaactaacatgcttgcaggtttgctttgacaagtatgaggcttgttgtccccagtggtttttacctggactgtctcatttagctctctatagaaatgctcatctgtgcatgggaggtatatagcccagtggtagagcacatacttacaacatccaggctctggtttcaatttctagctctaaaataaagacataaatagaataaaggtttatttggaattgaggttcagagataaaatgatttttttgtattttttatttaaattctttaattaccactcatatttacatatccatccccccattctcttgccttcccatcctcccaagttcttcaccaacctccccaacctcccccaactcctccccagggaccttcaaagtctgtcatatcgtttggaggagggcctaggccctccttgctgtatctgggctacaatagtgtccctccataaggaatgggctcgataaaatgattttaaagacacaaaattcttactcttgagtcttagactcacttagttctgtttgacagtggtgctctgagggcctcatagatttatttgtaaatcacccaggagagatttcttttcacaatttaaggtcctaaagaagtaatactattggtatttttacttctttggggtcaggaggggagctggcctcacatttgttgagatccttttgcctctgcctccaaagtgctgggattgaaggagtgcatcacaacatctggcttggagtttgtcaaacaaaagaaagcatgcccaaacagctggtgggcagaggtgtagcttagtgacaggacacttgcctgtcatgcaagaagccggggttcagaggcctgccctgcaaagagaacaacacagatgttaagctggatgtggtggttactcctgttacccctgcattgggaggctgaggcaggaagattgtcaaaagttcaaggccagcttgggtgatatagtaatttccaggccagctaacaagtccctgtctcaaaaaacagaacttaaaccaaagggattctaattttggagctgcggcttttgggcaaatgtctctctgtagagggtaattctgtctacccggctcactcccagacttgtgcagaaaaactggctaaggtgatgggcttcgtttgatttcctagtcaagatgctgggtggatgaaatagaaaatgcttgctctgcttgatgcttccaccttcttcctgtcagctgtcagccgtgcaccatctgtcccagcagcaggctggccttccctgttctcacactgagcacagtgaggtagctctctgtctggtgccttctggatccttctgccacagtctccctactgttttctagttaagtgctcatagtttgtttcatttacaaagaattaaaaaatctgattttgcaatcactttatttttggtttctttatttagggtgtgtgtgtgtgtgtgtgtgtgtgtgtgtgtgtgggagagagagagagagagagagagagagagagagagagagagagggggagaagagagagtgctcttgaatacacagtgttagagcatgcatatggaggtcagattactgatgactttgagtagtctgttctctactctcaccatgttagaacagggactttcttgtttccaacattctgcatgctccaggctagctggcccaagagcttatgggaagttttttctcaacttcccacctcaccacagaatgctggaattgcagttatgtctgtcctactacatttggcatttttatataggctccagggatcaaactcaaatgtttaagttggttatggcaagcacttatatccattgagctatcttgtctaccatttggtttctttttcttctttcctttattttaattttctaaaattttatgtttatggctgcttttcccctacatgtgtatctgtgtctgccacccacagaggcctgaagaaggtgtcagatcttttggaactggagttacagaaagttatgagctacatgtgggttctggaaatctggaggagctcctaatgctcttaaccgttgatctatctctccaacccctgctttctccttttattaggattctttccactgatcatattttggtgtgtggtttatacctccttttttaaaaaaaggtttttttagtgccgggctgtggtggcgcacgcctttaatcccagcactcaggatgcagaggcaggcagatctctgtgagtttgaggctaacctgatctatacagagtgagttccaggacaaccagagctacacagagagaccctgcattgtaaaacaaacaaacaaacaaacaaacattgcagtccttttaatatccgaaggcttgctattatggatgtatgctagcatgcctgccttctcttcatttttattgtgtatgctttttaaaaataattatgtgaatatgtgttcatgttaagtgcaggtgtctgaggagaaacattggatcccctggagctggagttgtatacagatggttatgagctgctaaacctggtgttgggaaccaaattctagctttctgcaagagcagcatgtgttccttaccaccaagccatctttccatcttcccccacctttcttttcttccttcattttttaagatgcactaatatttttatttattgttcactgcttgcatttgaagttcttcagtgacatcctccctttgattctatgccacagtccttaaccacacagagctgcaaccaaccccttcacgtttttgcacaagtttgcccattccttagttccttcttgccatcaaccctaattaggttatttggtgttcagaacaaaggaccctcctacacttacataaagtaggcctatacagatgggtgaaagcacacaaagatggactgggtgcttgtccaaaggttagcagctttgtgaatccacacatccagtagcaatgtcccctctttagccctggtggtaggtaagggagaagctgaatcttgaaagcacccaagtctatgcttctgtatgacttgaccatggcaggcttatcttcagttctttttttttttttaagataatttatttaatttaattttatgtgcatcggtgtgaaggtatcacatcccctggaattggagttacagactgttggaagctaccatgtgggtgctgggaattgaacccaggtcctctggaagaccagtcagtgctcttaacctgagccatctctccagccccttctcttcagttcttatagtgttttatttatttattattttaaagtaaccttccttttctaagaattttgtgtatttctgtttgcctgtgtgtgtgtatgagagcagaatgagcatagttttattgtggaaaagtgaggaagatctctcaagagtgggaggggctccaaggaaggagtaccttcttttctgagttttccacaaacgtatatcagatggcactacactgggtgtgtggatagaagacaaaatgcacagatccctgatgaaattcagagatgcttgaggatttggtgttggccttaatggcaaagcattgttagtcatatgttcttatgattcctgtctttgccaattgctcacatttattcagtgatttactctgtgccaagcaaattctaaaagctttacattcaacacctcacagtattctgagttacctacttttaagtatgcccattttatatatgggtaacaggcacaaatcaggtgactaagttgtatgaagttataattagtaagtggtaagtttgggattttttctttttgtgattttcctttctttctttctttctttctttccttccttccttccttccttccttccttccttccttccttccttccttccttccttctttctttctttctttctttctttcttttggagatagggtttctctgtgtaacacccctggctgtcctggaactcgctttgtatactatgctagcctcaaactcacagagatctgctggcctctgcctccccggtgctgggattaaaaacatgtgccaccactacccggtgatctatttcttaattatttgtattgagggttcatgtaactcagggtagtcttgaatttaaccatgtagcaaaggatgcctcctgaccttcctgcctttttcccaagtgctgggattgtaggtatgagttatcatgctctgcttgaatttgggatttgaatacaggtggtctcagctggccacaatggtgcacacttataattctagtatttaagaggctgaggcagggggatctctgtgagtttgaggccagcctggtttacagagcgagtgccaggataagccccaaagctatacagagaaaccctatctaaaaaaacaaaacaaaaaacaacaaaagtggtttccaagaagctgagtttgactctgtttttgtgtgtttagaatccatttttaagctttgtcaggtctcatgtggaaa

SEQ ID NO: 32 - DNA, 179771 bp, Cricetulus griseus
  modified_base (23560)..(23633): a, c, t, g, unknown or other
  modified_base (23967)..(24012): a, c, t, g, unknown or other
  modified_base (25012)..(25225): a, c, t, g, unknown or other
  modified_base (27207)..(27269): a, c, t, g, unknown or other
  modified_base (27558)..(27642): a, c, t, g, unknown or other
  modified_base (28034)..(28294): a, c, t, g, unknown or other
  modified_base (36588)..(36936): a, c, t, g, unknown or other
  modified_base (40895)..(41191): a, c, t, g, unknown or other
  modified_base (112869)..(112967): a, c, t, g, unknown or other
  modified_base (145691)..(151881): a, c, t, g, unknown or other
  modified_base (175480)..(175497): a, c, t, g, unknown or other
caaggtttcttctgatgcaatgacagttagtcctcagggaggaggcttccatgtcttttccagatgaatttctttaagtcttgtgtactaaagatatgatatcttcagtaatgggatcttattttatttttcttgaaggcacaaagggtggctttataccatttgttatttcttaaatctaacacacttcctttaaaatttagtagaggtgctgtgcatatagtaacttcttccatgtgtggtgaatatatatattcacctgggtagggtggcaccattttagaagaattaggaggtgtggccttgttagaggaagtgtgtcactgggggtgggctttgaggtttcaaaagcacatgccaggcccagtctctctctctctctctctctctctctctctctcctccctgttatgataaatctttctgccaaaagccactgagccccactgccacgtgtgcactttacggccagccgcccacccagtgagggccccaaatactacacagagacttctattatatacaatgctgcttgaccaatgactaggatttctcatctgctagctcagccttaattatcatatatctatatattttataagacttatcttatcagacaccttccatgggcatcctcccttgctggtggatcacatcatgaatctggaggaagagaggaggggaaagggaaccacttcctgcttgtccttgcttaaatatgagtctccctgctatgtcacttcctgcctggatcaccacttctctactacatttcccagaatcctctttgtctcctagtcccatctaacttgctgcctcattggtcaaacagtactttattcaacaatcagtaagatgaacatacacagaagtacattcgggctctctacagcctggaaatccattgccttccttaatacctaaaggatggccaatcatagttattgacctgaaagactgctttttcactatatcattacatttagaaagtgatagaaatttgcatttactgtaccaactcttaataactcacagccagttcagagatatcaatggaaggttttacctcaggggatgctaaattgtcctactttatgtcaacactttgtacaacaacctttgaaataattcgtaaagaatttccacaatccctcatttatcattatatggatgatattcatttatcatattccaataaggaaactttggaatgtgtgtttgacatggtgaaggaagttctgcctagatgagggttacagattgccccagaaaagatacaaagaggagattctattaactataggttgtaagatagacttacagagaatcaggccacagaaggtgcaaactcttaatagtcttcagaagctgctaggagaaatttctcaatcacagacgattattggggtagaaggtcatgacttaaaacatttaaaaatagctcttaaaggtgataaggacctaaacagtctacgaatattatctgccgaggcagaaaaagaactacaatgagtagaaaacagaatattggatgctcatgtgaaagactttagtttgctgagagaaaaagttttaaaagattttagttctcagagagaaaaagtttcccacaggccttggcccattacaaggaagttggccccaaccctgggcacatcctatggtttagacaggggcaattgccaagacaactctctttgggtcacacctggctggccaacagacaatcaaggacttttcagggtatgttctgtggtttttcctctgtagaaaagcaggtcacacctgggtgaccactctaacatgagatcatactttgtaatcaatcactttgtgccccttgcctgtatgctgatctatgattttttcctatataaagagcttgcaccccatgctggggtgtgcagcttccccgatattgctgacaccctactgggcattcgttcaataaaccctcttgcttttgcagctcttggtctggtttctgagtctcagaggctccttgggatcctgaggcccttaggggtctggggggtctttcacatgtagatcggataaaccttgatttagactgcattctggttattttgccatccagagaatatccttctgggattctgatgcagttggaagacactatattagagtggatatttctgccacataaacagaataaaaagttaaagacatatatagaaaaaaaattctgatttgattttaaagggcaaattaagacttcgtcaactgactggaaaagatccagcagaaactatagtacctttaactaatgaggaaatttcctgcttatggaaggataatgaataatggcaaatagctcttactgattttgggaacaattagcaacaactatccccaaaccgacagaattagatccataaaaaagacagtctggattcttccacgtattgtaagacaaactcccaattctggagttcttactttctacactgatgctaacaaatcaggtaaggctggttataaagcaggtgaggtaagtaaagtagttcaaagtcggtatacatctgtatagaaggcagaattatatgcagttctcatggtgcttatggattttacagaacctcttaacatagttactgattcccaatatgcagagagagtcagtcgtcttatacatagagactgcagaatttatccatgataatacagaattaacctcgttgtttttacaattacaggaaacaatcagaagcagaagcaatcctctacacattatgcatatcagatcccataagtgtctgccagacccactagcccaaggcaatgatgagattgatcatttattaattggtagtgtgctagaagcctcagaatttaataaaaaaatcatgtaaattgcaaaggtttacaaaaggacttctccatcacttggcaacaagccaaggagatagtgagaaactgtcctacttgtcctacttgttccttttataaccaaactccactgccagcaggctataatcctaaaggcatttggaggaatgagatctggcagatggatgtcttttactttacaaaatttggaaatttgaaacatgtgcatcatactattgacatattctcaggtttccaatgggctactgctctcaactctgaaaaagctgattctgttattagacacctgctagaggtgatggcagtcacgggtatacctgcacaaataaaaactgacaatgctccagcatatgtctccacaaaaatggaacagttcttcaaatattataacataaagcatgtcaccggtatatcacacaatcctacacaatcctaataggatgcttaaggagatgctccatagacaagctggtaagtcaaaaccccccaaatataggttgcataatgctttattgacactgaactttcttaataccaatgacaaagacaaacagctgcagaaagacactggactacggaaataactgctgaactgagtcaaccagtatacttcaaagatgtactgacctcagtatggaagcctggacacgtgttacattggggtaggggttttgcatttgtttccacaggagaagaaagcctttggataccaccaaagttgatcaagattcaagttgaaaaagaccaacctctcgacaaggatgagtgacaggtagtaactgaggtatatctcataaactaaatagaaacctcccaaaggaaagggaagtgtattgcttctatcttcacaggaaaactcatttccaggaatccaagaacactacatgggtagatgcttaagaaaagaaggtaattacaaccatcaaacaaaaggaatgtgacatacggtaaactttacagctgtctctcgaataactatttctccttatttcctagaccctatttaagtaaatcagtgctggatttagagttggatttggcttttctcccctaaaatccaagcatgttgtttaactaaactttagagtttctgtattaaatcaagaaataattcagcactagagaggaatttggggactgtctttgtctttcttggctctttccttcaagatgtacactgtctcacaatcattattttccactattgactttttcagcataattacatatacaagcaaacatttctctgctaacacttatgtttgagtcccacacagccaatgaagaccctcctgacaacaatccctggacgctctggaaaaggaattgggccatacctcctagactgcactggatccaacttactccatttcaactgacactccgactagagcttccagaactgacttcaatcaagttgaggatttcaacctagatcttcaatcaaacaaattccatctaacatgggctggatataatgttagagacttttactatactaacattttcttcccacaggaccccacaaggctaccatcatcccatttcagcaggtagtaacttggaggatgctacgcccctgttccctattattgtctgttagggtagtgtaagtctagttaggaatgatcttcttattgtttagggttggtattggaaggagatgttcaggtttggacacctctttcagatgactttagggtttagctgaaatagacatagttaagatgtgcaataatagattattgcatcttcttgtatttcacctttatgattgttagttttggatattttacactattaagttttaatccttttttagactaaaaggggaattgtagggagacacggtaaccatgccttgtaagggctggctacaggtgtgtctgaacaggcgtggtcaaagtgaggtcagaatgacgcggcatggactcttaagtgaccatgagcacatggaatctctcttccctttctgctgccccttctctctggcctcactgctctggcttgcatttggctggtatttatctgaataaaggtatcttgaatctacaagctttttccttcacctctcctcccctgctttcctctcccatctcttcccctccctccctccctccctctccctcacccaccctctatcttcacctgtggatcaggatatagctctcagctactgctccagggccatgcataccacctctccctgtcttcatcataattgactaagcctatgaaactcttagcatgtccccagttaaaagctttcctttctaagagtttccttggtcattttgtctcttcatggaaatagaacagtgactaagacaacatgtatcaacaaaattcctcaaagctatcatttgtatcttgctttacccctcagcaggcccactatcaggaaaactttgtgaaagaattttctacatgtactctttttattccttgtgatgagttcatgcttcaatttgccatcttatctaaaacacccaaaacacatcaactaccttaaaatacctcaaagagctcttgctttcatcctgtgtatgaccactcagcaacacgtggtgttcccaggtgctttctatctcaactaaggctattgtatgcttgttgttttcctttaaagtattcccttccagtctcctttgtctttactccttttctgcattctacacattgtgatccctcagtttttaccacaagcttctcctattttgtgcttccctttcatctagaattgttttattgctagctttaatttattatcctagccaaacccttcctttgggtacacatattagaatgactatttgatatgactggagaccctaaaagcatttcacttccaacaaatccaaactgtactcgggattgtcttagctttaaacctccctcctcattctgcatagcaatcccactgggtcatctacacttgcttaagcaagtaacaaatctggggatcagcttagatgtctttcttccttactatgatggtttccatcaagttcatgtaaaaatgatacagctcatttttttccagttgaaatggtcatgtcttgtatacttgtgtcaccattgtatggttgtcaccttttatttgtggaggattggtttaaaagacttctcataatcaacagaatcaatggatgccattctcatataaaatcacaaagatttgcccataacttaggtagtcttcctgtgagctttaagtcagctccagatcatttcaacatgtaaatcaaaggtgatgctatgtaaatcattggtacactgcattgtttagagatattaaaataaaattactttgagattttatcttaccccaatcagaatatctatgataaaaaaatgacaaagaatgctggtgtggatgtgttgaaagaggaataattatccactgctggtgagagtacaaacttgtgcaggcagtgtgcacatcaacgtggaacttttcaaaaaagctagaactagaactttcaaaggagcgaactataccactcttgagaacataccccaaagactgttgaggtatcctactatcaagatatataatcattcatgctcattgttgctttgttcacaacagggggaacatggaaacagcaaaagcttatcagctgatgaatatataatgaaaatatggaatatcacaatgggatattatccagctgttaagaaaaatgaaataataaaatttacaattaagtgcctggaactagaaacaatcattctgagtaaagtaagccaggaatcagactctagaatgacaaaacatttgtgtgtgtgtgtgtgtgtgtgtgtgtgtgtgtgtgtgtatctttgaatcttcagataaatattttccatttggaattcatacagagatcaggaaattggtaaggggcaatggggagatttcaagagacaggagatagaatatggtggcataaaggcttaaaagggagtaattctgttggaatgattgaatgagaaaggggatggcaaagcagggtagagggaggaatactagacaaatactaaagacattttgaaaaggtcatggaaacctactgctgtagaagatccctaaaatatatacataagcacatctaaaaagagtttaaatggaattgccctatgtaaaaataatgcccaactgaatactataggataacaaacagaaagctcagtaccaggaaatgggctacctcttttgaagttgttggacaatgaagtactatagacctccaaacattattggttattaccatttgttcttggttacactccagaacttggcagtatgatcctgttgttaaagacagaatatatgtgagtcacagttctgggtgaatctagctggtttttatttggaagcttcatccatactggttagctttcagagttctagaatgtgctatacatggtactagaggagaagagtaatcttcagtcatttccagctatgaaccctgagaactacagtaatgagtggtcaacctgtcaagacatgaccactgtgtaatagtgtcacaaatatcatgagagtaactaatgaaattcagatttcagattggatttagggtgtactctacaagatgaaaccatatctgacaccattatcaggatgggagcccatggcagaaaagtcttccactaggtcttagagaagaactgaatactattattctgttgaatggacatagcaataactgactccttatcattatacctgtagatcaatgcatatctctaccttcatctgagaatcatttatttgcagtgatggtgagtaatatagggatccctgactggtggatgggcagagaatagaagactctggattggattgttcagtcctaaatgggacactgcatcacactacttccttccaagctcaaggatgttgatagaagagagcatataagaactataagagctgggtggctacaagaaagcagtgtcttctagacacagcagttgttacagcatgcaaaagacctaccatggagagtggaagctaacatgaaattccgcccccaccccagccaaggagctgttggtaactggtagttgctcagagaggaagagtcagtttctttgagtgtatttgcaagtgggtcatgttccagaggaaggaaggccacacatctgagaacatatgaacaacaaaattagacctgtgacctaagcaaataaaaaggtatgaagttgggtgagggaagtggaggtatgtctgagaggagttgtgtgttgaagagtcattatgattaaaaaatcttatatgaaattctcaaagaattaatacaaaattaagatgctatcataaatcatacagagattttgattggatttcatttataaattatgatttcatgaatatctgagcatctgaaaatattgcctccctattccagtctcatcagaactttatatttacctttggaacccccatattttcaggaaagttaagtttgtcaatatatttcacctcttttctacctaagtagacactgttatagggactttcagaactgtgttgcgaactgaagatttttcaaagaggagtcatttgatcttccctggtgtttaaatttcactgatggaaagttgtgatcttttgaagagaaatgtgttataaatcaagaagcctaagatgtattgggctatttcagagccttggacaagtctttatcgttggcctctgcatttaacgtagcatttttgtgtgaccagtagataaaaccttaaaatttgtgttatgcttgatgcacttctagcctctattaaatattaaagctaggaatgactggagactcggatcattatggaagtttccctgcctagttgagcatcactggtaaattttacagaagatttctactcctttttaaatttcatctactttaggactctgtctactttaggactaagaaagatgttttttctattcattaatggagccatgtctttggagaacatgactttgagagttgtggtgttaacttgtggatatatttcagggagaaaaaaaaatttatgttgactcataatatgtcaccctcttgtttcaggagttttgtctttacattgagagtgagattgtgcacaaagggtgaatctaacttaggtttggtgttattctgtagtcagagcttgatatgtaatgaagtcaccaatgaactcctggatccaccttaagtagatacttattgagtagtaggtaatccctcaattttttcttggcttcaaacccatgttgtgctttattactttttaaataaaattgtttgtggcaatacatcttaatattcttttctatttatagctatgatgtggtgttcttgacttccttaagatttcttttgtcttgtttgctcttgttgatcaacagtaaagtttgccttgtccagacacttcaacaagaataatggtctctttctttaagaccccaaacttaattctaacaatttgggtctcagtctaggatcctagttcccccgagggagaaccttagatctcttcccaggggaaaagtgtcccacaagttttggtttttgtttgtttgtttgttttttctggtccttgggtgaatggggtctttggtactatccaggtcagcaaaatgccccaggtttcaaagtactgaacagcacagggaggggttgctcagggaaattactgtggtgataaggaatactctgtgcacaaaccgaagtcaagaaatgctgcgggaacagcaaagtattcctttagaggttggttattctaggggttgaggcaagtgtttgatgtgaaatttgggtccaagaaacctccataaagggtcgtggagcacaatattccccatgattgggaaaagaaaaacctaaggcaaaaagagctctaaaagtaaataaataaaaggaacaaataaaagccaaagaaagaaaacatccccctactccaggggaaatcaactcatctggctggcccagacattccatcaaccctccccaccctaaggagagactgaacaatgtgaggtctccacacttgttagtctccccgtcttccctctctgtattctctcttttatctctcattgccagctccttctgagaacctagaaaaacttggatctggtctggaggaagggacaaagagtctcttggtgtggttacttctgattgccttagatgatgccacctcatagctgcttttctaacatggtaaagtgccacacagataggaccccctatggaaggcctcaccctccctggggagcagaaagggtttgggataggtagggtgttagttgcagggggtggggggggaggtatgggaaaaggggagggagaggaacctgggattgaaatgtaaaataattttctttctaattaaaatttaaaaatgaaacaaacaaacaaacaaaaaagcgccacacagaaccactaagttttaaatcaggatgtactattttcacacgttggcttccaaaggtcttaaattccagccaacatggagagtcgcatgtccatttgatctctgcccacaccatacttgagcggtataaaatggagccaagaaacatcttgtgtttgagaactgagaagagggtaaaacatggtccagataacaatactaggcaccaatagttacactttgtgtggtaaaatatatgaactcaactttcatgaattaagaccaaggaattccttcccctgttcctttgttattagggccttccagcctagaacacaagtaccatctccttctatatcaatgctaactaagatgccattttttaaagaaatgggtaaaattggtcatattttttttgttctgttttggagacagggtttcactatgtagatcaggatggcctccaactcacagagatttgccttcctatgcctcatgagtgctgggattagaggtgtgcatcaacatacctggtgggaactatgcacatttaatctttattatgtttgaatctcccaggaattgtggtcttatggaggatagactcactttaccatggagtctgagctcacaaacagaaagaaaatgtgttttggctgaggacagcataaaatggagatgaccatatgatctggccactatctttgtcaatgacatcataaagatgatgaataccaggtgactttggcactatcttggttaatgtaattacatggcatgaagcaaattggtgacacccataaacttcctggtgacactgaggcctcagggacttacttcttgtatattgtacttagggagtaatgccatatctccatgatgtttatttgttctgctttattttaacttctgcacattgctttgcatgatatattcactagcttctagaggggacttaaagatggatgtagatccaggacaaacaggttaaaataaaccagataaaatacaaatataatccagtaagttcacagtttaagagtcacatcttaaagagtggagaattcaagcagacagtctttttatagtccccagtgaagaaatggacaaaacagatatccaggcccttctttgttatgcatactatttatatcagatacattatatttttaaaactttttgttgattctttgtagattttgcatcatgtatcccaatacctttgtatctaccctctgcctttgcaatcttccaaaataaagtttaaaagaaaaacaaaaatcccaaaccaaataaacaaaaacaaaacaaaacaacaaaatctgcctagggcagctgaagtgtgggccagtgagtcacacaatataccctttagtccatgtaccttcacttgtgtttattaaaatgagtcattggtctggttcaaggttttggcttcttatacactatcaacactgggctcttactgggactcctcttagatatcctgttgtcctgtggcatggagattattcacctttggatctgcaggtctggccccttcacatgccccagcagcttatagaagaggtggatgttggggtggactagttcattgccctagttctgggcctgagaggtagctgagttggtcagcctgccaactttccctcatcatcaccaccagggtgagctctccagcactgtcccaattagttcaccaaatgtagcaggtagcaaggagcctaggaaattctccatctctcatgccctcagggcaggctcatctgcattcactattcttttgcctatacaaagggcagggaccgctctcccgattgctgcagttggtgagggacagtgccagctcttctattctcatgcctccccactccctggccaatgaggccagctctcctgcctgccacagtcagcaagaggtggggcgtgtatttccctcacccatgccaccatatggcatagaatggggggcatcagctctgctctcaccctctgtgccagctcagctgtgcctctgccagtaaggtcagctctagtgttttgtccaggtgaagtgcagggtctgctctcctgagtgctgtggcccatgatgggtagggccatctctcctactcttgtgatcctggggccagctctcccacctgctgcaggtggcaaggggcaagggggagagggaacctatttcttacccatgccatcatatggtagaggaggagcagcggggtcagttttcctgcactcaggctggctcacctgtacccctgcccacacacagggtcagctttactgtgatggccaggtgaggggcgtagccctctctcctgagtcctgcagctggtaatgggaagggccagttctacccaccacaggcagtaaggggtaggagcaggggtggggatcactccttcacccattctaacagatgaggggtgggtccacatctcctaggcacacttgttgtacccctattgacatggtcagctttagcaaggtccagtcttcccggtgctgcagcccttgaggggcagggtcagctctcctactctcctgacccaaactttcccaccatcatgaccctagttgatgtcccagatgctgggcatctgtgtggcctttgatggcaacatgggccattgacatcaacccagacccagtttatggtacgaccacagacccagacatggtccttgtgcagcctgggcccagatatcatcatggccctagctggtatcccaggttacctagattgacatggctccagtggcagcatagccccagaacactaacatatcctgaggagacagcccagaccctgaccatctgctctgtcttctgatatctgtagcaagagtcacagatatcaacacagatcctggatgggataggaccatgcagatatattatttaaataaatagtaaagtgacttatcagataggtgtatccatttgtcatgttaactcatgagaaaaggaataaaagctaggaactaggaactacagtggatgttcaggagaaggaaacaaagatgtggaatatcttttaacaatgtttcatcttacagaagggtggttatcagtgaagactctcagtcactgtattgttacccattgggatctcttcatccaggagccttgcttgaggagggaatgtctaaggcttttctgtacacagttctggcctgaatataacttaaaggataaagagtgcattgatgattacaaagtggagtcagagataggttgataactggtagtttattgggggaaaatactcactcaagggaaccagtgaccaggtttgcacctgagcaggatggacccagaaatgcttaccggtcagctcagccaagtgagagagagccaagtgctggccttcttaaacccttgtttaagtgggcatggtcagcaatacctataatcagggtttctccctacaagagtggtctttatagaaaaacaaatgcaaacaacaaacaaacagcagtactgtattgccctacaacttgatttctttgtaggagggggggtacttactaagtttttcaggttgtctgcctctgtttgcagatgtacctaaatagattgtgggtattggtcaccccaagtgtagccagagagagccttagtatggatgcttgtgaagacagatacttctgttggtttgatcctccttgatcatggatactgattgccactcacccttgatgaagatatcagaagatgactcttcatatttaaatgttctgtttggtgaggttctcatatattcaatctgttaatccctgttccctgtacacaacccaaaagatgacgagtcatgtaaacaaatctataaaggttataaagaaataaggaagattggtgctttggggcccactagttgtcactggattcagcagcaagtctctgaatattgaatgtacacctcgggatgcagctttacaaaggaatctcatgagataaagatatctgtagtaaaaacacttgataggaagctcatccatggagagactagagaagatcctctatctaaagatctgtctatagtaaccccagcatcagagttttcttaatggatttcttagtctagttttactggatgctgcaaacatcaatttgatgatgttctgctatatatttgctgctgctttgtatcttctacatacactaattccaaaacaaatgcaagggtatggtagcaactctatgtacagcataaaaagtgtcttgtggttttttttctttttaaataaggtttaacttaacagtatgtcccaagaaatattaatttattagattattttatgtattatcactgcctaggaggacagcccccagtagcagcaagactctaaagtaagtcacagcattggtgcatagtagacttttctatctgagagggttacagaaaaaagacactcacattttctcttgatgttttccttctttattctctatttttctacagtttatatatcacaacaaagtttttcaggcaatataagaattacaatgtggctaaattacaatgaatacaaaacaaatagtaaaaaaaacagcatgtttttcatatcccttacatgattaaacattttgcatgttacaggtgaaaaacaaattatcctaagaacccatgtacattcaccatacccaaccagcttgttatagattaaccatgtagacaagcaaggtattcttctcagggaggtcttttactagcaggttatattttgcagttgcaaaggaagggccaattactttttacttatttttaaaaataatcttatagggaatcttaaagaaatcacaaacctaaatttttatataagacaagaatcagttagctctactttaagccttcagggtgcatatcaatagtttttttatatcaggatagtgagggcaggaatgggtacaaggagttaatcatcacctttgatcatcaaccaatcctattaagaaaatatgtcagctaaaaacacttgggctgctttgtattttgacctcagctttgtgtccttgtgaactttagattgttttcctgggattatccatattaaaactattattaaaacatctcatctaacctgaagttattttaaggctttgtttcagtcagtgatgcacaccaaaacctataactgcatctttcagcattaagattaaaggattttgagccagcttggctcttgggactcaattgttttgtttgtctttctttcatttattttttgcttcatgtcagaaattttactttactattggaaaagagtattttgatttttattgtaaaaccccatttaatttcaagaattaattttaaattaatttaatttaattttaaatttaccactcagatgtgaattgaaaaacttttattcttgtaactgtgaatattatatatatatgtacatatatataatttcaattttttatactcaagttactcaattgtttactcattttatacaccaaccatagttctctttcccttccttactcctgctcctcccacctccccccacccctcatccactcctcagacagggtaaggccttcccatggggattcaactaagcctggcatatcaatttgaggtaggacaagtccccctcacacccctgcatcaagggatatgttgatatttatcaagggataaatcctggtcccaatgccaggagccccaccaacagagcaagccacacaactgtgattggtttctcagaaaattgggaatttacctcaagacctagcaataccactcttgggcatatgcccaaagaatgctcaatcatactacaaggatacttgcttgactatgttcataacagcattattcattaatagccagaacctggaaataacctagatgcctctcaactgaaaaatggataatgaaaatgtggtacatttatacattggagtattactcagtggtaaaaaccaatgacatcatgaaatttgcatgcaaacagttggaactaaaaaaaaaaaagtcatcctgagtggtgtaacccaaacctagaaagacaaacatagtatgtactcactcataaatggatattagtgtaaagcaaaggataaccagattacaatccacagccctagagaagttgggtagcaaggaggaccctaagagggacatgcatggatcatcctaggaaggggaagtagatgagatgccctgggaaaacggggaggaaatgagagatgagaacatgagggaatgggatggttgagttgggggagggaaaagagagggagaacaatgaaagagatatcttgatagagagagccattatggagttagggagaaacctggtgatagaagaattctcaggaatccacaataatgaccccagctaagactcctagcaatagtggagagggtgcctcaactggctttcttctgtaatcagattggtgtcatagaacctttatccagtaactgatgaaagcagatgcaaagatccacagccaagcactgggccaagctctggagtccatttgaagagaggaaggaggagcaagaggggatcaagagcatgatgggaaaacccacagagacagctgacctgaacttgtgggagcttatggactctgaactgatagctggggtgtcttcatgggactgaggtaggccctctgaatgtgggtcatagttgtttttcttaataactaacttgagctacatctatgtggctctttaaataaaactcacgggccttagctgtgtaagatttccttgtatttacttttattcatcaaaactctatataagctaacattattgttgtcagttagactagacagtttagggaggaatcatcttcatataatccacaggtaaaaatgcccagtagaacaggatgtttccaggagataaacacactacattacaggcagaggggatctccccacacccattcacaccatgccagataccagagaaagatagtagcagcagtcctgtaaaggcaaggcagaagttaaagacatttatggttctgtagtctcagggccttgcctaacagagattgactgacccatcaggaggtttcctcctggtgggctgacaccttgaaattcaaatgccacctgctgctcctctgacaaggcaacaggcaatgtatgcagtttctattcagttttttttttttttaaagtgttgctatgcagcactattctaagacaaacaactcctatcttcataagaccagctgtgcctgcacacaagagatgatcacccttgggtttgtagagggggtaaagtgggtcactgaatcctcaatctaacttctcttctagccacttgtatgcaattgagccttaatcattgtggcctagtggtttggctaagaaagattagggacaggaggtccacttatgcagctatgggaaagccactgtacacgttgtgtgggggcttccagtctggctgctttggagatacccctgtgagtaactgttcgcccacactcagtgagtgaaccccatacactcattgtttccccaggatgaattttggtgagactaaactttggtttgttgtcaggacctcatgaggaggggtggagggctgtttagtccctctctatctgggagaaaaatttcctaacaataaatttgttaatgttattatgtcttatgttattaaaataagtaaccagtatggagaagaaaatgttacaaggatgcaaatatgtaaatgttttaataaagaaggacatagatagatgaagattaagatggttggatattttccaaatagaaaagactggaaaaattttataagttatgaaggtcagagaaaattatataaggtacataaaggatgaaacttagaaatgatgcatatgatattaaagtttgtaaggacaaagataccgaatacaaggcttggctaaaatgtatgtctaatcaaagttagatttagagatgtctggttattgaaatactatttaacctgaatggtgtgactaggtatttaataatcatacttggaggctattcggatgtgttcagagagattgaaagagagaatattttctccctagctctccaaggttaatgagatcccacagactgtggctcatctctcaaaatcttctctaattgtggaaagatttcctcagcacttccaaggaaagccacagtcaggctaagcaaggcctttgactcaccctcacactgatggataaccagtaaaagaaaggccagaggagcctggggtttctctcaaggccaagagacccccctgaggaccagatcttcaactggcctggacagtacaaaaagaaaagttaatcttggccattgcagtcataaacattcaacaggaaagtataaccaaagactaggagtgtctgagcctgatagctaatcaggcttcatacctgggaaggggagtgtgaattgaagaaagaagcaaacaagaaacaagagatagggaggacattcagtaaacactgaatgtgctcaagtttaatgttcaaagtttttaaataccccaattaaaagagggggagaaggcaaaagacttcttttctaatgatacaaggaacaagcagagtaattacttctccaatacccaaaatatcaagtaactacatcctgagttaagtattttgttgtttggcaggacatgaatcgaccacaccttaggccaagaatcctgttgtatttacatcctaggccagtcatctttgatgtttcaccttggaagaacaagggcaggtaaaaactctctgaacataaaaatggaatggggtcaattccgtgggttctcacagaggattggtaacagtacaaagaactgaactatccacacattagatgtaagtctccatcagatgttatttagacaactatacctcactaaaattttcttcctgataaaaagaagttgccccaatataagacttcagatcttggctcactgtagcacctccctacagccatgggagaaaggaccactattgttttaacctaaaaattaaatgatggataatcacttctttccccatctagaagccaaatgagaaagacattgtgttgacttttagctgatgcagtagctataaaaaagcacaaaagcagactgttggttctgtgagagtacagtgacattaccaactggaccactccatgggtagaaagaaagatttattgggaagagcagaagtgctcttaacatcagagccacctcttcagctccagatatttatctcttgattgttactgggcactttaatatattttaaaatatttcattatgagaattttgtttttcaaaagtcattgtaacaaattctaaagaaataataataatgtataatatttacttttaatgatgtgttaaatgccattgtctctacattaagtcttatgcaacctaattagctaacttttaagtgtgaccccaatttgtggataaggaagagcagacataaaaactgagcagatagttcaaactcatgcagccactcacactaatgagatttgaagcaaatcatcagacctgtacccttgatcaataggcatttacaaaattcacttgccaattattgtaaaatatttattgagttgtatgaactcgttagaattctatgaaatcaccaataggaaatttgtaagggccaagttcctgccttctctcaaggctgagtaacatttacactggtttttctttcaggcaaaaggcagaagtaatgagaaaatttcttcagaagattctttttgctttgtctccaggcaaccatcacggcttgccaaatagagcatgcaatactctttaataattgcacaatcatatttatgaacacatatcatcctttacctccagatgcttccagattcagatacaagacacataagttcatacctctgcaaagtgcagaggaagacagaagctagaattgtctgtagtgatgcagttatgtacttatggtcacaagcatgttgccacatgcagcaagtaggattcagggactggaggaaagccctccacctctttctctatgttcctgactcatgtattcagtactgttggcctttgtcattccataaacagcagggggcatgcttgcctttctgatctttctccccacactgatgttgagttttgttgaatttcctagtgttcttgatctgtttcttaggatatgttacatcttgtgttggaaatcattcaataatttgggttcattaagagttaaatataaccctatgttcacattcttcggtaagagatacgtttaaaattcaaatagaaaaattgaagttagtggattgatcgcttaatttacaaaactcaagttaagtatttgaagtaaagggaccaaacgagtagactatgtcaatttgaagtcaaaccagaacactttctgtgtctggttgtgtacacactgtaatttaacatggattgtttgcatgtttcaatcgaaccatccccagcattagatgctattattttctcatcttagaggctttgcaactttagggtatgaaagaaccaggacttgtgatgtcttctttgtaccatttgtcctcaccagatgtagtcaacacttaatttgggaagactgtttagagagtataaaacatatttccccatgaaacaagtaatagatatctggtatcatcctaactgaatatctgaaaggtaagtgttccttttaaagttcattttgcctgtgtttatttttgaaataataatagctaattatttcttcttacaaagaaaatttcctattttaaaatgtttttcttctttgcaagaaatagatacttctaatttttaacttttagaccaactccatgctttatttatgaacctggaagaagatgaaaagtaacttataggcagcatttattcacttaaagtacatttatgaagactgcagattactgttgaaatagtgccacaaagccttccaaagatgactgaggactggaagtctgtgctgtggagcgtcttctgcttgtgccagctctccctgctctcaaaggtcctgtcctggctgcagtggagcatgactacctcctgttcttctcgccaagtgcctcccatggaaattcttgaaaaataaagcaacatttcaacccacactttaatgagtggcctggaatccctatccgttagctatctcagaagtgactcatacaattgtctagcctgtgctttcctaacattttccatccactgtaagttatttttccatcttttactgctagagagcttttcatgtttgccagctgagaaactagaaataaatgaaacctatagtttcaaatttgaatgggctgctgtttgagctttttaagtgcagtagtgatctagtgtctggcagaagtacttttgggaaaatggacagttagaatgcaaatgtaagttactcacctgaaatttacttaatgtgaagtcaaaccctgtaacctgacctgctcatgctatctactgttgtcttttgtagtcactcatttgtttgttaccgtttgttactgtggaagcacctttaggccacccaaagaatctaggtatttaatttcaaagcaaaatcaagtcctgccccatcaattagggtagtgtctgaaatacaagacaagtgggatattgtaattagggcttcaagtatgttctctggggtaactgggggtgggggtgaggaatatgctagttatgtgatttgtgaaacgccaagtgttcagatatcagctgatcactcatttgcttcctggagattctcacattgcagttcacaagagcagtatgtgtgaaatgctatagcagaccgagaagttacatttttaaagaacaacctatatggtaaaaggcatttccttgttgactcatatttttcaaatttctgcagccctaaactttagcatttgctttaccagtaagtcagaagccacgtcttgggtgacactcttcatcagaagcagagcagctgtggggagacatggagtagatgactcagggctttggtagttctgctgtggtagttgtggtatgtgaccttctgaaaatcagtgatttcatcttgacttcaagtgtttctaaagtatttcctactttgtctatctcatgagatttttgttttgagcatcaaatgaaaggatacagagagaagaaaatggtagctaagatgctaccatttgtcacattgttctatgcaggcacaggctcaggaattataagctgagttggctttttacggactttgctagacactctcaattacagacaacagctggcagagggatgttttctttttcaaataagaccttaggaagtttgtgttacccaaacataacttcccttcttcattagacttgtaagaactgactgtgacttattaaacaaaagagcggtcattggccaggaatactcaaatgttaaacaaatagaattaaaagcttcaatggtcctataattgattacttactatgctttaaaaaaactatacatattaaattatattttaataagatatttgaatagagaaaactagtagcacagaacatctccttagatgagaatatctgtttgtggggcccctacagtgtgatcaggatctgcccatctgtccctggtgcatgagctggctttttgggacctatttccctatgatgtgtgcctcacccagccttaataggggagggggcttggtcttgcctcaacttgatatgccatgctttgttgacttccctgataggccttaccctttctgagagtggatgggggaggctagaaaggaggtgggggaagggaactggaggagaggagggaggggaaactgtagttcctatgtaaaataaacaaaaaatttaacaaaaatacatattacagtattacaataattttgataattttcatctgaagtagacaatttctcactatttcttatacatgtactgagtattcttagagttattttttattagttcaaattaggaacaagcttgtttcacacgtcagtcccttctccttcccctcaccctcacccctcctaccccacccagacctaccccctaccccattcaccctccactctccaggcagggtagggccctcaatgggggctccacaaagtccaccacatcatcctgggccgggccgaggccttccccatgtgtccagggcaagagtgcatcccttcacgtgggatgggctctcaaattatcttcttacaccagggaaaaatactaatccactaccagtggcctcttagagtgcagaggcctcctcattgacatccatgctcaggggtctggatcagtcctgtactggcctccnnnnnnnnnnnnnnnnnnnnnnnnnnnnnnnnnnnnnnnnnnnnnnnnnnnnnnnnnnnnnnnnnnnnnnnnnnccctctctgcaactaagttcctctgtatagctatggttatctgcctctgctttcatcagccactggatgagggctctaaaatggcataaaaagtagtcattcaatctcattttaggggaagtgcgtttaggttatcttctccaccattggctggagtgttagttcgtgtcatccttgtagatctctggaagtctccctattgccagatctctccttggacatataatggctccctctaatatggtatctctcatcctgctctctattcttccccccccaactcaatatttctgctcctcaatttcctcctctcctctcctctcctctcctctcnnnnnnnnnnnnnnnnnnnnnnnnnnnnnnnnnnnnnnnnnnnnnngcacctcccccccccctctcctcccctcatgctcccaattagctcaggagttcctgccccttcccattcctggggttcatgcatttatctcctagagtacttcatgtttcctaatttctttggtgaagagggctgtaggctttatttgctctatgtctaaaattcatatatgagtgagtacataccatgtttttctttttgtgactgggttacctcactcaggatggtttcttctagtttcatccatttgcctccaaatttcaatattccattgctttttttctgctgagtagtaatccattgtataaatgtaccacattgtctctatccattcttcagttgaggggcatctaggttgcttccaggttctggctattacaaacaatgctgctatgaacatggttgaacatatgtccttattgtatgaacatgcattatttgggtatatgcccaagagaggaattcactttttaatttcattctttggtgttttggtggctagcttattgagttcattgtatattttggaaatcagccctctccaaagttgctgtacaagtttgcactcccatcaggagtcgaggagtattccctttctccaagtcctcttagcataacctgtcattgattttcttttggtgactgtatcctttgccttctcagttttaggaggtcccatttattaattattgatctcagtgcctgggttactggtgctatgtttaggaagtggtctcctgtgcctattcggtcatggttatctcccaccttctcttctagaagattcagtgtggctggatttatggtgagatctttgatccatttgcacttaagttttgtgcatggtgacaggtatggatctatctgcaatcttgtgcttgtctgaacccagttatgccagcaccatttgttggagatgctatctttcttccattgtataaatttagcaactttgtcaaaaataaggtgttcgtaggtgtgtgggttagtatcagggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctgtgaagaactgtgttgggattttgatggggattgcattgacgctgtagattacttttgtcaagactgccatttttactatgttgattctacctatccaagagcatgggagatctttccattttctggtatcttctttaatttctttctttaaggactcaaagttcttactgtagaggtctttcactgttttggttagtgttaccccaagatattttatgttgcctgtggatattgtgaagggtgatgtttttctgatttctttctcattgtatttatcatctgtataaagtagggctactgattttttttgagttaattttgtatcctgcttctttgctgaaggtgtttatcagctgtaggagttccctggtagagttttttgggtcacttatgtagactatcatatcatctgcaaatagtgaaagtttgacttcttcttttccaatttgtatccctttgatctcttttttgtctcattgctctatctagaacttcaagaacaatattgaagagatatggagagagtggacatccttgtcttgttcctgattttagaggaatcgctttgagtttctctccatttattttgatgttggctgttggtttggtgtatattgcttttatcatgttaagatatgttcctgttattcctgttttctccaagatctttatcatgaaggggcgttggattttgtcaaaggctttttcagcatctagtgagatgatcatgtggtttttctttttcagtttgttaatatggtggattacattaacagattttcgtatgttgaaacatctttgcatccctgggatgaagcctacttgatcatggtggataatttttctgatgtgttcttggatttgattcaccaatattttgttgagtatttttgcatttatgttcatgagggatattggtctgtggttctcttttttagttgtatctttgtgtggcttgggtatcaaagtgattgtaactttgtgaaaagagtttggcaatatcctatctgcttctattgtgtggaacagtttgaggagtactggtattagctcttgttttaatttctggtagaattctgcagtgaagccatctggccctgggcttattttggtcggaaggcttttgatgactgcttctatttcattcgggtttataggaggatttaaactgcttatctgttcttggtttaattttagtaaatgatatctatccaggaaactgtccatttcctttagattttcaaattttatggagtacaggttttcaaagtatgacctgatgattctctggatttcctcagtgtctgttgttatatcccccttttcgtttttgtttttttttattaacatgttctctatctgccttttgattagtttggctagaggtttgtctatcttgttgatcttctccaggaaccatctctatgtttcattgattctttgtaatgttttcctagtttctactttattgatttcagccctcagtttgattattacctggtgtctactcctccgtggtgagtttgcttctttttactgtaaagctttcaattgttctgtcaattctctcatgtgactattccccagtttcttcatatgagcacctagtgctatgaactttcctcttagcactgctttcaaagtgtcccataagtttgggtatgttgtgtctacattctcattaaattctaggaagtctttaatttctttttttatttcttcctcaacccaggaatggtgtaatcgggtgttattcaatttccatgagtttgtaggttttctgcaatttgtattgctgttgaattctagctttaaagcatggtgatctgataagatacaggggattatttcaattcttttgtatctgtggaggtttgctttgttgccaactatgtggtcaattttagagaaggtgcttttacaaatatgggtgccttcatatttggggcatagatgttcaagattgagacttcatcnnnnnnnnnnnnnnnnnnnnnnnnnnnnnnnnnnnnnnnnnnnnnnnnnnnnnnnnnnnnnnnattttagtttaaagtctaatttgttagatattaggattgctacaccagcttgtttcttgggcccatttgattggaaaatcttttcccaaccctttactctgatttaatgcctgtctttgaagttgaggtgtgtttcttgtttatagcagaaggatggattctgtctcatatccattctgtagtatctttttatgacattgggggatattaatgtccattgattgtttgttcttgtttgctttggatttattgttggtggtgtcattatgtgtggattttgccctcctgnnnnnnnnnnnnnnnnnnnnnnnnnnnnnnnnnnnnnnnnnnnnnnnnnnnnnnnnnnnnnnnnnnnnnnnnnnnnnnnnnnnnntgtagtgctggatttgtggatatgtattgtttaagtctggttttgtcatggaatatcttgttttctccatttatagtgattgaaagttttgcagggtactgtagtctgggttggcatccatgctcccttagtgtttgaaagatatctatccaggaccttctggctttcaaagtttccattgaaaagttgggtgtgattctgataggtctgcctttatatgttacttggactttttcctttgctgctcttaatatttttctttattctgaaggtttggtgttttgattattatgtgttgaggggatttctttttatggcccagtctgtttggtgttctgtaagcttcttgtactttcataggcatatccttctgaaggttggggaagttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttctatttccagcatcacctcattctgtgttttctttattctttctatttcagctttcatgccttgaactgtttcaagtgcttccttcacttgtttagttgttatttcttggctttctttagattctttgagaaatttgtttacttcttgaattctttggtttgtcttttcctccatctcatgtaattttttgcttgttttttcttccatttctttaagggattttcttgtttactctttaaaggactctatcattttcttaagataattttgaggcccatctcgtcttcatgctctgtgttgggcttttcagatcttgttggtgtggagtccctagattctggggggtgccacataggtttttctgttattgagtgtgttcttactttgtcttcttcccatcccttcttccagtgagtgcaggtggcttagcttctggtggtagcaggatggcagagggtggtgggtggacaagggtgaggtgtgtccagactcacagtggaccttcctgaggctcctgcacccactgaggttagggcaccgctgcagggcagagggcagggtgaagacaagaatgaggtgtgtctggactcagggtgggccttccgatctgggctggtctactcttgtccgggggttggggtatttcaggcagaagtgagcagaggttgatgggagaggttgggaaacagcagcacccagactcacctgaggctagggcaccgctgaaggacaaagggcagggtgtagtgttttgttttagatattttattaatagaacgactgtttcaacaaggcatattaatttgaattaatatggtatatgaaaatcaaggatgccagtcactgttggctagaatatacttttcagatctcaatagcttagcaattgaaacattttatttattgaaataaaaagtattgacagggatgttgggggtgtatgcattaaataccagtactcaagaggcagaggcagaggcaggcagatctctgtgagttccagaccagcctgttctataagaaccagttccaggacagctttttgaacccccccaaaagaaataaagaattcttgtctatttttattttaattgtgtgtatgtctgtgcttgtctgtgtatgcttgtctgtgtctgtgagtgtgcacgatcttcagaggctagaggcatcaaaatttcttggagcaggagttacaggcagttgtgagccttctgacatgggtgctggaaactgaacttgggttctctgcaaaagccatatgtgttcttaatcactgctctacctctccagttgggttttcctctttttgagtgtgtgtttggtgatgtgttttacatctgagtgtacaggtctgcatttatgagtatacaaacagaggctagagtagaatgttgggtgttctctattgttctttgtgttactaccttgagacagcatttctcactggaagtgaagcttgccattgcagctatagtgagctcttggaattcatttgcctccacctccccactgctgtgtttacagacatgcatagacataactagctttttacatgggtcctggggatttgaactccagtctcatgctttcagtatgactattcttaaccaccaaatcgtcttagctcctaaaagacattatgccattgcagaccaacatcagggtcctgctctctgctgctgctgctcagtgacactgacagaggatctagctgtctccttaaacttgcctgtttcaaggcaagagagggtactatagtctcccattgtcttagaattaacactcattgcttagtttcccattttttagacagaatgagtcacatttcaaccctcctatcttccccccaaaagcatcagaaagtgaaatttaccacattcctaaaacaaaaaggagtagaagcagaagcatttggtaaatagctctaatgactaaaggtgaaaactggagttcatggaaattaactggagatcattatgttatgtgaaataagtcagccctacaaaaataagcatatgtgttcccttttgtatgtagaagctaagaaaaacagcaacatgaaatgaaggtgaatagttagggttgcagaaagaggaaaagtaaaagggggataaagaagagcaatagaagggatggacatgatgaaagtaaattatgtgaatgtgtggaaatgtcatcatgaacccctctgtataatacattttagaaattaaatgagaaaattattgctaacattttccttgagagctatgtgttaagtcctgtgtggaatgagttccacatagtttctcatgtaaatcacacagtgaaaccatgaagtgaatttaattactacctctattctaaaactggaaaaacagatgagatatattaaatgggactggagagatggctcagcctttaaagactaggctcacaaccaaaaatataagagatatattaaatgattcatccagtggaatggatgcagtgagtgttagattcagatctgtctgactctagaggtagcaactatagacttccaccttcaaaactctacagtcatcaaagttcacatttaatgaaaagggtatgaacagggattgctccatattcttgtgttaagcactaaatgatttccctcttatatttatgacaagaggagcccaatgaaggaagccagcctattagctgagggagcaggagaggtgccatgcattccaagcatcttaattctggttttaattacttagaccaagcagaattattctatgtaacatgcaatttttgtatactttaaaaattaatggtgaatgtggttcagatttgagagaaactttacattcatgtggtagttttagaagtttttagagttaggctatttttttcaagtaaactggaatgactactgacagaaatcttgtgaggataatttggagagtttctgtctactctacctcattttgtttgtgtttaggccttatattagtgtctttgttactgttatgtttctgtgaagagacaccatgaccagggcaatgtataaaaattaatgattatcatggccagtagcatggtggctgataggcaggcatggtgctagagcaatagctgagagcttacttacatctgatccacagaaggaagcagggtaaaactggattattaagaatattcctgcagcaactatagtacttgaatgaaggagagctgagactcactcccagtcacacttccaaggccacacctcctaatccatcccaaacacctgtaattactctttttctgccatgacagccagctcccaaataatgacaccaagacttcttattaatgatgaaagctcagcctttgcttaggcttgttccactagcgattataagttaaatttgtttgatttgattttaatttatatttattttaatctacattctatcatatggctcaatatctcatgtctttgtactgcccaagttgcttcctctgtgtctggctgggaaatctgccttcttcctagagttctgtctctgtgtcaaagtcccatctatacctcctgcctagttaatgaccattcagctttttaattgtatcaaacacagcaatacacctttacacagtgaataaatatcctacaacacagtccctcaactgggaacctaaaattcaaatatacgagcctatgcatgccattgtcatttaaatgactacatttagcatgacacatttgtcacaatgagtgaattaatatagactcactactgttgctctgctttattcagattctttagcttttcctcagtatttctttttgtttcattatctcatctgagatacctcattgcatgtagctagcatgtttcccctggttcttctccattgtgacacaattccatatgcttccttatttttcctacagttttgaagactaataaagtgttttatagaatgatacagctactttctataacatgaatctcatgttcagactgggattcttagttcttgattctcaagtcttggaggaagaccatgaagatcaaattagcctcacgttttactcttttttgctaattttccctccaaattctctctccccataacatattaagtaaatttttacatttcataaatgtgcataatgttttggttactatctcccccactctcatcttccttcatttcggtgtcaaatcacctccctccactacctgttctttccccagtttaaagacatttgattttgttatgtgatctgttttgctcaatgagcaacatctatgtgaccatcagattagcactatccattgaagcttgatgggatcaccagtggatatgcaactgaaggcaatggcttttcctttccctgagtcagtccacaggaaatagctcatcactaaaaaaaggagtggagtggaggttccctgaatatcccctccattttcttatggctgttggtgggtctattcctgtgcagctgtatgttgcggctgagagtttgagatgacaataattgtatattttccagatggatttcacagatcttctccgtgtgttctagctcttacaatctttccacttccttttttgtggactttggaaataatggaaatttcccactgaaggaactcaggactctcaggagtgacatcctgagccttccctttcaagcaatagaatgcagtctggcacaaattgtcccctcaggtgaatagtggaaagaggatgctctagatgagtttgagagactcactcagtttgctgactcaaagccgttggtggccaagatctctagctatgtctggactggaaactcaacttggccaaaaatccatttatatgataccagtgatgagaagaaacttgatatcgggctagaattagttcgcaaaggatatacagtagaagttcctgaagatgtgaaagaagacgggactgtcacagatatgttgaaggacatggccactgaagcagatgcttctcttgccagcatactcaatgagaccaaagagagccctgaagagacagcacataccctatcctgcctcagcttatcagaaaaaactatatagtgttttcttatgtagcccaggcttcaaccgtgaagtgtttagaactaacttctcatcagttatcatttccattaaataaaatgattttgagtaagaaaaaaaagaaaagaactccttgtatttggtttgtaatgtattccatcatcctgtaagatgtgtctacacttggctgaacacttgtgaaaatgcttttgcaagcaacatttttattagctctttgaaaattgtatgcaatgtattttgagcatatgcactctcactgtccccaacctctcttcactctcaccaccctcctatcctatcgccaccaaactttgagatttttttcttctttttgaaatgtatttttacatcgagttcactttttgttgtacagttagtcttggaagtgggacctcccctggcatgtggttatctatgaggggttatatcattaaaacaagtagacttttcctctcccagtagcttttaaatgctagagctcatcatctagctgttggattttatgctctcctgtcccctctatgctgggattttgtctggctggagcttgtgcagatattgtgcatactgtcaaaattgttgggagttcatatgtgtaacatctctattgtctctagaaaacaccatttacttgatgttgatgtcatccaccaccttttacattacagtctttctgatccctctttggcaaagatccccaagatctctctctctctctctctctctctctctctctctctctctctctgtgtgtgtgtgtgtgtgtgtgtgtgtgtgtgtgtgtgtgtgtgcatgtgtgtgtgttcatgagtgtgtgcttgtgtatatgtgtgcaatatgtatgtcctatttaaggctgaacactccacaatctcttgttctctgaatgttgaccaattgggagggggtgccactgtatgtcatctattgcaataagaagctgctttgatgagggtttaaagatgctctgagctgtgcgcatggttcattagatttatattaataatgtgtcaatttagcaaataatagtattggggtctcctgtagagccaatgatccatctagtcacaggtttttggcctctgtaatgatgccaggtatataggttccatatcatgcagtaggtcttagataccatcagaaagtggttggttgctcccatatcattgatgcccctctcacaccagtgggtgtatcttgttcatatctagatgagactgagaactaattttctcctccagaagcaagcataacatcttccagcaccatgaaaatagttagtatggatgcagctttaagtgagcatcagcttgttatcttcaagggctcaagtatgtggtggtttgggtaataaaatcttaccatcaaattctggagggtaaccaagagcagtggcaatagactgtaatgtttgagggtctatatgatgctattgaccatcaatgcaaaagagggcagtccatttctgatagtggggcttttgtttgctagtatgaggtatctagttggggtagcttggtggctaggttggctggtcagcaagcttcaggggtttgtttgtcttcatttccccagtgctaggattcaaactgaccacagctcttttatgtgggttttgaagatcaaactcattcctcatgatttcttgacaagcacttgactgatgaggcatctccctagcccctccctttcatcttttccttccttctatcgaatcagcattgtcctgatctatcaacagcctgatgagagaaggatgtttgcttttagatgccaaacaatcacctgtctcaaaccctttgtagtcatctttggatattctgcttataggttctcaatatcaatatgttcattttttactttctttttattattattgttattgtttgttagagacagggtttctctaaatatctgtccaccctgtaacacactctgtagtccaggctggcctggaactcagagatatgcctggctctgccttccaagtactgggattaaaggcatacaccaccaccccatctttcactttctgtaggcctatgttcaaatcacctccccagagagacctttgtagggagacaccgtaaccacacctcctaagggatggctacaggtgtcctgataaagcatgtcaccggtataccacacaatcctacaggacaatcagtgtttgagagatctaataggacacttaaggagatgctccatagataggctggtaagtcaactccccccaaacatatgttgcataatgctttattgacactaaactttcttaatgccaatgaaaaaggacaaacagctacagaaaaacactggactatggaaaaaactgcttaactgcttaaccagtatacttcaaagatgtactaacctcagtatggaagcctgggcatgtgttacattggggtaggggttttgcatttgtttccacaggagaagaaaaactttggataccatcaaagttgatcaatattcgagttgaaaaagaaaaacatctcgacaaggatgagtgacaggtatttactgaggtatatctcataaactaaatagaaacctcccaaaagaaagggaagtgttttgcttctatcttcacaggaaaacttatctccaaaagcccaagaacactacatgggtagatgtttaagaagagaaggtagctataaccatcaaacaaaaggaacgtgccttatggcaaaatttatagctgtctctcaaataactatttctctttacttcctagtccctattcaagtaaatcaatgctggatttagagttggattttgttttcctcccctaaaatccaagcatgttgtttaactaaactttagaggtctgtattatatcaagaagccaattgatagtactactcagcagaaaaacaaaaacaaaaacaaaaacaaaaacaaaaacaaaaacaaaaacaaaaacaaaaacaaaaacaaaaacaaaaacaaaaacaaaaacaaaaacaaaaacaaaaacaaaaacaaaaacaaaaacaaaaacaaaaacaaaaacaaaaacaaaaacaaaaacaaaaacaaaaacaagatgttgctcagaatgttttccttccagatgatgactgagaagctaattaaaaaaatggtatcaggtaccacaagagtaacagaactgtgctgttttctgggattttgttttttactttttgtttttgttttttttgtttttttaaatggagtgtgctggatgtctctacaattttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagagaagaatttgaggactgtctttgtctttcttggctctttccttcaaggtgtataccgtctcacaatcattatttttccacgattgccttttccagcatgtacacatatacaagcaaacatttctcggctaacacttatgtttgagtcccacacagcaaataaagagcagcctaacagcaatccctggatgctccagagaggaattgggccatacctcctcaactgcactggatccaacttactccatttcaactgacactctgaccagagcttcgagtaatgacttcaatcaagttgaagatttcaacctagatcttcaatcaagcaattcccatctaatatggaatggatataatctgttagagactttcactatactaacattttttcccccacaggaccccacaaggctactatcatcccatttcagcaggaagtaacttggaggatgctacgtccccaacccccattattgtctattagggtggtgtaagggttgggattggaaggaggtgttcaggtttggacacctctttcagatgactttagggtttagctgaaatagacatggttagaatgtgcaatagcagatttctggtatttcacctttatgattgttaattttggatactttacactgttaagttttaatcctcttttagactaaaaggagaattgtagggagacaccataaccactcctcagggctggctaaagttgtgcctgaccatgcctgtcagggcgtggtcaaggtgaggtcaggatgactcaggataggttcttaagcagcagcgagcacatgggaggccccttctctctggcctcactgctccactgccctgggcacactctggcttgtgtttggctggtgtttttctaataaaagtatatccttattgtaagctccctttgttccttgatagaccttctattttttttctccatttttaatttaaattagaaacaagattttttacgtatcaatcccagttccttctccctccccacctctcctgccccccactaacaccctacctatcccataccatttctgctccccagggagggagaggccttccatgggggctatcttcagagtctgtcatagcctttgcaatagggccttgccgccccccatgtgtctagactgagggagtatccctctatgtgaaatgggctcccaaagtccattcctatgctagtaataagtactgatctactacaagagactccatacatttcccaggcctcctcactcacacccagattcatggggtctggattagctccatgctggtttcccagtcatcagtctggggaccaagagcacccccttaatcaggtcagctgtctctgtgggtttcaccagcctggtcttgacccctttgcttatcacttgtcctctgcaactggattccagttcatttcagtgtttaactgtggttatctgcttctacttctatcagctactggatgagggctttaggatggcatataagttagttgtcaatctcattatcagaggaggacataaggtagcaggaaggttgtgtagggggaagaatagaggagagcaaaataagagataccataaaagagggagacattataggcataaagagaaatcaggcactagggaaatgtccaaagatctacaaggatgacaccaactagccatctaagcaacagtggggaggataccttaaatgccttcccctgagaccttctatcttacccctttgctttcattcttcctccctctcttcttcaattcaaaatatattcttctctcaacaatacaccctaaccagtttcccctcctttcacttcttccagctcccttatctcctctttcccccagatccactcttcatgtcaattacatcattttaactttttattattgatactttaagaggaaaggtcctaaaagatcagagattttgttctgtacattgctatatgtccttacaatactcctgtatatagtacacacttagtatttgttgagtgaatgaagtttgtagatagttgaacctgctgttttcagtggtaatattactggtaaccattatgatcatagtgtataacggttaattaagatttgattcagtaccaggtttattccttgcctcatgaagcagtcataaagacaaattaatgataaatgcctctttttgcccttctttagtcactttctcgagtctgacttttagacactgtctaaaaaatatttaataaactaaagggttttccctcaccaaataagaagctccattcattgaagttttataccagacagatcacacagttgtcattctttcctagttattcataaccatggagcatttttggtcagtggtttgatgcataaattctaagctcttttaactgctgctgtttacagtgttcaatataatttctggctagacattttacctccccttcctcctccccacccctgccgtttcaccccttctggtcatgttgtagtgctatatcaatagctgtccttcaagtttctctttgtgaaataataataaaaatacagcctgatcgtctcatatggtttctataaatgttaaaagacaattattcaaatgtattctaagcaatgggactttattataaaacatgcaaatatgcatttctttaaattcactttcatgtgtttcagaagaaaaacagtattttttcattagctctagaattggtggttacactagtttcttttgtgctagtgtggcagaaatacctggtagaaacaacttaaggaggcatttattttctttcactcataatcttagagtatttgtctagtggggaagacatggcaaaacagcttgtggtggtagcaggaacatgaggcagtgactgttcatgtcctagtgggcaaggaagtagggaatgtgctggaaccagggctgcctataacctacaaaggcttgtctacagtgacctcctttcctcagacccgacctcctaagtgtttcaaagcctccaaaaagagctgacaatttgatacacgatcatatttggggtacttcagactcccaccacaacagtggttaatgataggttgcagtactgtgctttttaagtgacggtttgcaggtggactcagtcagtgtttgcttcctcctggaaaactgctgggatcttactctgtatagaaaactataagcctgtgagccttggggctacttagctttttcattttgaaattacttcataattttgctcagatgttgaatacatatactctgccctagaaaatatagaagtaattgaaccaacattgtttggagatgctcatttggggactatactgagtcatgaaaatcttctgaagcaatcaaactgtgcaccaggcccgttgctttggtcttctattttgtttggatttgcagtgctggggatgcagcacaggacctttggatactaggcaagtgttctatcaaggagctgtacaacagcctaccacagatctttacaaagaaacccttgtataatgtaccagctacaaaaataaatttttgacatgtgaatttcatttgtactagctttttaaaattagtttttatattagtatagcagtgtttgtggctaacctggaatttttacaaaaaatgccattatcattttacaataaatatatagactatatgtttgctggaaaccaacatttgtgtgtatatataattcacttttatatgaataacccaaattcaaatggttgttttcctatgcatgatatttgtttactttctaaaaagactgtcaataaatttctaatcatttctcttctgtctttgagaaatatgtttttaaagtattgaaagacccctgccccttagccctttctttctcaagtttgtctcctcttcctcctggcggcggcttccccgatccccgcccccggtggccggtggccttccccctccacccgctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacccctttcccttggctcggggcgcttagccacacagaagctaagtcgccccgggtacccgagtctccaataaagcctcttgcttttgcatccaagttcgtggcctcgctgattcctgggtgcgggtctccttctacgaaagtacctcttcgggggtctttcagtattaatataaaaaacatgactcttttatcttgaactcttctctttaacccatgttcattgatcaagattttttttttctgtattctacttggtatgtctgtttttgttgttgttgtagtggtggtggttacttctttattccttaaaatccttccactttttctttttgaacttggatgttttagtatgaaattaaaatagactttaatattaaaggtaggactatgggctgaaagatatatatatatatatcataatacaaagtgaaataatccagacagaaaaataacaataactttatgatctcatgatgggaaatatccttctgtgtgtgtttatgttattggttattggttgttgaataaagtactgttggccaataaagaagcaagttagccatgactaggagtcaaggagaattctgggaaatgtagaaaagagaagtctggtgatccaggcaggaagtgacatagcaggcagattcaaaattcaagcaaggacaagcaggaagtggttctctcttgctcttcttcctgctctaagctatggagccgccatgtgatcccaggaagaggacgccagcggaagacatcctggataagataagtcttataaaatatatagatttatgataattaagactgagctagcatataagaaatcctagtcaattggccagcagcattgtaaactaatataatactctatgtgttattttggccgtgcaagtggcaggtggcactcgggtggcttggcttaaagatttattgttacaatctcacattccacaagaagaaaaatgtatgaaatctaaaaaaaaaaaaaaagaaagaaaaagggtagagggtagaacagcatggccttgggtgattaatggtaaatggcaaatgggagatgttgatcaatgattatataactatagttagacaagagggatatagaaatatccataataaaaacatgcggagacaaaaagtagatacataatcacattaggttggtctgaagaatggagaggatgagagaatgatgctaatgatcatgaagtttgtgtgagagagatttcatgagtgagcatgtgcacatatgtgcaagtacgtgtgcaggcatgagggcattctcaggagtcattccttatgaattttcaccctgtgctatgcaagtgtctttccttgggacctatgactcactgattagggtaggctggctggtcactgagccccaagggttctcccatccctgctttcccagaaccggtactaaaggcatccaccactatattcggctttattcttttcattttgtggagggttccagggattggactctcaggtgcttgcttgcaaggccagcactttatggctaagacatttctcaaattcaaagtgtcatttttgagtgatgaaaatgttctgaaattggtcaaggttgttatctaaagtaaacaaactaaaatcttttgttttatgtatgaatggaagaagcagctgagaccatgtgttatcacctgtcaggtatccctcagtgaaaatcacataagagattctactgtcactgtgaaatgacctcattaattgcttttccagaacttagggaaaaaagggcttggtctaagagattttcaaacttttcctaaatctagctatcattattacattgtttggaaagacgtagaatatctacttcacctgccacagaagaggagtacaagaaaaactgtcatactgtggtttgaattgtgacagaaattatttcctgaagcatttttttttatttaccagtagaatcttctttctggtcatttactctagagcagtggttctcaacccctgagtcatgaccctttgctgggtcaaagactcttttacaggagtcacatatcagatatgctgcatatcagacatttgcattgtgattcatggcagtagcaaaattagagttatgaaataacaatgaggtaattttatggctgggtcacaatatgagtaactgcactaaagggtggcagcattacgaaggttgagaatcactgctccagagtaacttcactccctttaaacacttcagaccagggctgatcaagctgtatcacttcttatgagtgagcagtatatattgtgtcaagggtatctttgggtttcagctgatgcatcatggattctgggacttaaatacattccttcccaacattacattttttttttgatacaaccactaagaatggcaatcattgttctcattctttcaggagattctgctttagcacattaccacagttaattaccccatctttcatatgagtcatttgcatgttgccatcatggatatgctgccttgtctccagagctactctgaccaatgtggcttcaccttccagctagccaaagcctgtccattcttagttgatggacaaagaaaaactcaattcaccctttagcttcacttgtgcttaacacccttgggacccatttttaggagttcatccaagatggaaacacattgttgttttactggctttcttactcatatcccccacaaggggattatggtaacagctgtacatattactcttcagggaccatgctggctagttttatgtcagcttgacaaaactggagtcatctgagaggaaggaaccttaatgagaaaacactgccaggagacttagttcaggcaagcctataagcattttcttaatcagtgattgatgtgggaagggccagtccatggtgtgtggtgccatccctgggttcatggtcctgtgttctataagaaaacaggctgagcaagccacatggaacaagccagtaagcagctctccccttggtttctgcatcagcttctgcctccaggttcctgccctgttttgagttcttgccttagattctctcagtggactgtgattctggatacagtagccaaataaacccttttcaccaagttgttttggccatggttttcattacagcaatggtaaccctaactgagacagaaatctgatggccacttgtgccaaaattttactcttcacttgggctcatttcaggtgcctggcaggatttccatcttcagattgtgcccggccctttggtttccagaatttctagatcagattctactcagctctgcatgtagacatcttgattgtccactgaaagtatccagtgtgttttctcacactcagtctctgtgctctttctgcagctttagcagccggcatagcaacaccaccagccttatcactaggcccagatgaaccacaagcaagaatgtacaggatgcttaaaccatttgcaaaagaaattcagcaatttccagaataagctggctgctgattaatcttctaactacaaagtcaggatatttgcacaatagaaggaaaataagtctccaaaaagaatgccaaggcaactgtaaaattaccaatcataccagaccccagcaagtcagtgagaagttgcctctccatttggggagtctggtctcaagaacagtgctgtgttcattgtgccctatctcaagtcttgttgaaggcatgcctgcatgttcttcatattctcctctagtgtgattctatggtttctgtgacacaaaagcccatatccaaccacactgcttacaccacattgcatctctaccatgtctatgattgttctagttcttgtctgaacttctctgaggtgtctactgctggcctgatgggagtgggctttttactttaccaaaggaagttctgtagttttagtactaatgtttctgtagaggttcccattttggaaacctaaagagcttcaggtttttcctgaaaggaaaagagttcctgactgccaaacttccattcaaatagaatcactctgacagaccactgttctgtcaaggcttataggtgaccttgtggatggcaagggtcttgtttgtgaaacccatcttcctaagccattgcctaagaacctcctctcctgtgactcttgctaggagtgatggctaaataggcctttgtaatacctgggatgcttttatctttagaaataagaggagagctaaggatatttgaagttgacctgaactcaaaggtaataattaacccaatcaattcttacatttttaacctgattctagttcacgaagctgttcttctgttttgcttgtttgatttgtgctaattctatgatgtgcatcaattgatcacacacacacacacacacacacacacacacacacacacacacacacacgcgcgcgcgcacacacatatatatcatacgtatatatagtctttatatagtaaaagtatctatgattagtgggcttcttattttgttttcttaattaggaaatattaatactattaataatagatagtagttttgcacatcagttaatatataccacacattgagttatgtgtttcatatttgttatttgatctcactcacctcggcttattttttttaaaatcatcctatcactaggaaatattaatactgttaataatagatagtagttttacacatcagttaatatataccacacattgagttatgtgtttcatatttattatttgatctcactcacctcggcttattttttttaaaatcatcctatcaaacagaaagaattaatgagttaattggctttagggagttctacaacttacactttcatagaacatggcaatgctgagattcaaatcaaagtctatttacacaaaaattaagttaattaacactagaaacttaagaaaaacatcactaataaattaagtatgtaactttaggcataatttgttatattataaagtgtatttagatatattaatataaaacacattcaagtagtgaattctattgagaagaaaaggtaaaaagctctgccaaccactagagtatgaacaatgactaattttacatgatatatatacaacatatatttaaaagattattaagtctaagattttattctctcttctggaaacaatatagaaataaatcagtttctacacagatatctttttagttttctaaactggtaggtagagctttaagtaggtcacattttttgtaatatgactcataagtgagcaattcttaaggacattttaaatgtggcaattagacaacaactgtatgcaatgtggcaaacacacagtttaaaattccagcccacattttgaagtcctttagaaatttgatgtcattctctaagtcagaagggaaaagcctcagatttctccatttccgaaaccacataggaggcaatttactgtaagtgagcagtggggctcagacaactcaccagatatgtaacagtgaacagcacactgtggtcagtccacacgccaagtgacagccccactgtagctgcccagcgctggtctcacaataccaactacctaatttggctaaaaagcatttaagagttaatttgaactgacataaatatttgcacctaaaagcaggggcaggacatcagtttttttttaagcagctttcttgaattaagtaatgggaataaaaatatgtcaatatcttccttttggacaaagaaagaattattagctgaatgaagcaaaatttctaattttgatttaaaatgctcatcctaatacaggcaaatgtcagctactcaatcatattagctggttataaataatcaaaaaatggtttctacttatttagaaacaatattgctttctcgattttgtgatattttcagtaattcaattagttgcttgtgggtttatttatttacttaattttatttatttattttttgtttttttactttttatatatttgaattacaaacaagattgaattacatgaccaggcctcccagggacatcaaccaaacaggaaatgctatgctactataagaccaggcacacagcatcacatcaaggctggatgaggcaacccagtagaagacaaagggtcccgtaaataggcaaaagagtcagagaccgcccctgccaccattgtcaggagtcccacaagaacaccaagttactcagcataacaactatgcagaggacctaggtcagatacctacaggttccctcatctctatgaacccccttgaatccttgtcagttgattctgtgggttgtgttttcatggtgtccttgacccctctggtgtggatttatgtcttccattctattttattgaccaatgtgtctgtttttatgccaaaaccatgtggtattaaaaataataataataataataataataataataataataatagtaataactatcctagctctgtagtagagcttgaaatcatggagggtgatgcctccagaagttattttattatataggattgttttaaccatcctgggtgtttttgtttttccatatgaagttgggtattgttctttcaaggtctgtaaagcattgtgttggaatttagatgtgtattgtattgaatcttcagattgctttttcataaaatggccatttttactatgttagtccaagtgattcataagcatgggagatctttccattttctgataccttcttcaatttcctttttcaaaaggaaactaaacaacagaaggtgaggaaatccaggtaatattatattatactttaaaagcctattcctcacctgattggaaaatctaaaacaaatggataattttcccaataagtacctcttgccaaagtaaaatcaagatcagataaacaatttaaatggacctaaaatgtctaaagaaatagaagcagtcattaaaagtctcacaaccataaaatacccagaaccagatgttttagtacagaattctaccagacatccaaagaagatctattgccaatactcctcaaattatttcacaaaatagaaacagaaggaacattgtcaaattcattttatgccaccacagtcatcctgatatctgaaccacacaaagatacaacaaagaaagagaattacagaccaatttccctcatgaacattgatgcaaaaatactccataaaatacttgcaaaccaggctgggcggtggtggcacacacctttagtcccagcactggggaggcagaggcaggtggatctctctgagttcaagaccagcctggtctataagagctagttccaggacagtctctaaagccgcagagaaatcctgtctcaaaaaacaaaaacaaaaacaaaacaaaagaaaaagactgatcactgggaatccagcatggaactaatctagaccccatgaatgtgggtgtcagtgaggaggcctcagaaatatatggggcctcttgtagtagatcagtacttattcctagcataggaatggaatttgggagcccatttcacacagagggatactccctcagcttagacacatggggagggcctaggccctattgcaaaggatatgacagactctgaagacccacccccatggaagaccttactttccctggggagcagaaatggtatgggataggtaggatgttagtggggggcaggagaggatgggagggagagggaactgggattgacatataaaacaatctggtttctaatttaaataaaagaatggaggaaaaaaccttgcaaaccaagtctaacaacacatcaaaaagattgtccactatgatcaagtaggcttcttcccagagatgcaagaatggttcaatatatgaaaatctgtcaaagaaatccatcataaaaagcacatgattatgtcattagatcctgaaaagcctttgacaaaacccaacaccccttcatcattgagtcttagagaaatcagggatacaagggtcatactgaaatataatgaaagcaatatacatcaagtctacagacaaatcaaattaaatggaggaaaactcaaagcaattccactaaaatcaggaggaaaaaaagacttccactctctccatacctactcaatatagtacttgaagttctagttagagcaataagacaaccaaaggagatcaaggggatatatgttagaaaagggagaagtcaaacttttgctatttgcagaagatttgctagtatgcataagtgaccccaagaattctatcagagaactcctacagccaataaacaccttcaacaaagtggctgggtacaagattaactcaaaaaaatcagtagtcctatatacaaatgacaaatgggcccagaaagaaacagggtaacagcactctttacaatagtcacaaataatataaaatatcctgggtaactttaatcaaccaagtgaaagacttgtatgattaaaaacttcaagtatttatttatttatttatttatttatttattaatctatctatctatctattctatttcaagacattctttttcaagacaggctttccttgtataacttactttgtagaccaggctggtcttgaattcagagatcctcctgcctctgccctccaagtgttgggattaaaggcgtgtaccaccactgcccagcttggtttatttttattttttgagattatgatataattccaacattttcccttccttttgttccttccaaatcctcccatatagccctctccccaaatccctttaaattcatggcttcttttttcactacttgttattacatgcacacacacacatatcatatatatatatatatatatatatatatatatatatatatgatccttttgatttttcgagacagggtttgtctgtgtagctttggagtctttcctggagctcacattttagaccaggctggcttcgaactcacacagatccatctgcctctgcctcctgagttctgggattaaaaacatgtgcctctacaatccgactttctgcccactttggcatgtccattagtgtcatccttgctcaggacgtgtgcctctactgtccgactttctgcccactttggcatgtccattagtgtcatccttgctcagctcatgtttagacagtcatgttggtaagacttcatggctgtagttctgatattacaatctcacagttaagtccctaatcctctggctcctgcaatctttctgccctctctttcacaatgttcccaagccatatatgtggaagtgttttttagatgtgtagattgagaccaggctcccaactttgaattttgatcagtggttgttttccatagtggtctccacctgttgcaaagtgaaaattcttgacggagatgaagtttatatttatttctgggtataaggacaaatatttactgattgttgggaggtattatgctggtttaaaactggtgttgtggactctcctccaataactattacttcacaaacacagagaaggttagctaggtttccaataccaggtgtgccttttctcttgttgagtgggtcttatgaacaaaacaatcccagacttacataataataattgttgaaaagagacaccatgaatttcaagttgagtggggaggagcatatggaagtgtttggatggagcaaagggaaaaaagaactgtaatcataatttcaaaattaaaatagcccaaaacgacaacaacaaaatgcagcaccctgcatgtattgatatttcaacatttcttccaacgaaattaactaatcccttacttctgagtttagctttattcaaattttaaagtctcaagctaatcaatcacaaattcagagtcataagctttctggtgcaatttccagtacagtcgttcccatcataatcctgtggagcaatctttaccacctgcacttcttggaggattctattattcagaacacatactggagcaacccataacctctgtttgcaacattcaaaggctgtagcctgccacaaccctaaacatatccaaatttctgcccaaagcctaagaaccacttggttcttatttattggcaaattgaatctgcatttgctgtgtattacatgattttaaaatttgtttgtctaatggaacttttaagtcaaactatttaacatatggattatttcatatacttctttgaggtaagaatatttaaagtctattctgtggattataaaggcaaacaatgaactgttattaattgtggtcttatgtatactataaataccctgcatttatttctattaacagaattttaaatattttgatcaaactgtcttatgtcctacctttccgaaatatttatcattccatttcctatttttgttaatttttaagctcttatgtgtatttaatatatatgataacaatatttataaccttatcaatcatctattatcaaccatttctttatctatatttatctatattctctctctattcatctatttctctttctattgtttgtatacgctatctgtcatctatatttctatatctatcatctctatgtatctttcatctatctcttatctatcatctttatttaagtatctatcatctatcatctgtctatcatgtttctatttatctgtactccatctactgacttatctatctatctatctatctatctatctatctatctatctatctatctatcatgtttccatttatctacattctatccatctatcatctatctatcatttatatttatgtataatatatctaacacttatttatttatctgtaatgataactctttctgccagccgcctgatttccgttgccatgttaggacccccaaataacatacagagacttatattaggtacaatgctgctggccaaatgactaggatttcttattttctagctctgtcttaagtatcaaccataaccattaatctacatattttataagaacttatcgaggactccagacaagtgtgtcctctcttcctggtgatcatatggagacttcctctttactacagttcccagaatcctcctcaactcctagcctcacctatattgcttccctattggccaacagtgctttatttatcaaccaataagacaaacatacacagaaggacttcccccatcttctcctcttttctgtctaaataaaagaagtgttttaacattaatatagtaaaatatataacaaaacagttatcaagtaagaactatattcaaggtatttagttcattcacatttagcaagatttaaagaaaatattctatcatctatcttatctttgtgagtctaaagtcttatatgtagcttatcttttataactaaagaaaactacaaccataattatctgtcttcaactccaccaaagaccacagaagggtaatatataaactctagatctgacagagacatcttgctacctggacagtcatccaaaattcctctgtacattggggcatatatcttcagcctataggccacagtgtgtctggcagacttctccatttcaggaagaacccttcaggactgtcttgttttgccagttcagcagtcactttcctgtgggtcttgcatgtccagtttaaaccttccagacaagagcagttccttgcccaaatggcttatcttgccatgttgaaggcaaacttcatattgagtttcttccatgcccatcctcctttctgatataattggtgtgtcaggagcagttgtgtctcatgacatgaaaacccctataccatttaaatgccatatactctgtaggtctttgaaaagtttgaagaatatctatccatttcaaatacatccctgtatacttaaaaatcctaactaacctaactgtaatttttgactattatacctgattatatacaatctgtatttaattattcattacatttgaaaagatctgtataaagacaataccaaacaagaagagatatttacataaaacaaaattaaccttaaatttgtatcaataaatgaaaatccataccaatgcaaattattcacttctatctcctattccccttttttcctttcaaaagagattggctgtgatcattaccatttataaccaaccccatttaaatgaaaacaaacatttataaacaatatttgggaatttgggcgtcgttcattctaaactgcttcctgctggttgggggtgatgtccataccatggggatcacgataaaacacagaaacatggccaggtccttgtttttgtagtctgtaagactgtatcatctcagctgttttagatgttggatcacctgggacactgcttcagggggtcttgcttcatcaaaccatattattctggaaggaatctatagctttacattttctgtggaaacacaagcaaaaactcttttcccaagtaacctgttcttatatttaaatttagaagtcaaagcatttttaaaatatataagttggattaatttagtagcacctttaattaaatgtattttagcagctgtagctctttcctcggcaatcaaacaatttaaagacaacaatatagcatacagtatccagactctctgtgggttttccatctttacatggcttatttatttatttatttatttatttatttatttttataactctatctcttttgcttttattttttccttttatgaggcagggtttctgggtataactttggctgcccttgaactcactctgtacaccagactggccttgaaatcacagaaatctgcttgcctctgcctcctgagtgctgggattaaaggcatgcaccaccacatcctggttactctctttttctttctttcttttaattattttattctgtttcttttctctcacaagcctttgtatattttttaaacactttgtaaacctttagaggttttactttttccctctgaatctgtcttttctgtgtatctttatctttttcttctagccatgagtcttttatctcctaaacagcattcctaaaactaaagccatggctgttttagttgctgtcatttcaagatggcgagggtatgtttaccgccagcactgagagttgtgctcactgccttggtctatgctgccatcaaggagtatgctgccagcttggagttgtggtcgctgccactgccagttgctcctacaaaccattcagttgttagcagggcctcttaaaagagccctgtgtccccaccccctatactgagtaagaaaacctcccttaagagagcctctcgagtctctgcttgtctctagcaaaaaggagaccacctgagaaaatgctgctaccaagaagtcatgcttgtctctgttcttttgcttctaaaatcctttttaaagcttttgtgaagtatttatgttcgtaaaaccacatgggtgccatttgtaatgataactctttctgccagcagcctgatttacacctccacgttagggcccccaaataacacacaaagacttattaggtataatgctgctggccaaatgactaggatttcttattttctagctcttcctaagtatcaaccataaccattaatctatatattttataagaatttattgaggactctggacaagtgtgtcctctcttcctgaggatcacgtggcaactctcctctttactacatttcccagaatcctcctcaactcctagtcccacttatcttgcttccctattggccaacagtgccttatttatcaaccaataagacaaacataaacagaaggacttcccccatcatttatctctttctttctctatgtctgtctatctatctatctatctatctatctatctatctatctatctatgtattatctttttatttatgtataaactctctatcagctatctactatcttagctcaagtgatactcaaattcttgtgccaggcatattttacttagcaaaacatttaaccacataaatgtcagaatttccttcttttgtgtatatctactatattttctttatttagtcaccagctgatggacacttagattgtttctttttttgagtttgctaaagaatgctgcagtaatcatgggagtacaggaatttcttcacactgatttcttttctatgaaataattatctatgtatttacatccttgaaaaacatttgttatttttcccttttgataatataatttcctataaatgtgaggcaataactctctgtttataatcacatttgccaaaagtaatgaccaaagaaattaagtaataatgcatggaccaaaagcacatacattttcaataatatacaaacatacactgtttaataatatacattttctaaatgctctttgcttgccaccatcataatacctttcatcacatcaatttaattttctgtactggcttatgcataaaagcataagataaatctacactactattgtaaatgatctgaaaatgaccagtgttttgatccatctaatttgaaatctatctatacttaggatattataaagaagagctatttgtgcctcctgttggtttgtggatagcacagaagaagcacccagtcatttacaatgatattctgggcacgaagaaagttataatcatttcacaaattggtggtcataatatacacagaacaaagatttctttagttcccaaaaatagctatcatatttgtccatgtgctcaaactggtagagaacacccagccctctacacatgcttcatggattttgtcatctgtttctgagatctagagtttaaaagtctagaaaatttggagtagaatcactgcaaagctattacatggtaaattgtggaaagttgagattttaaaaggaaagcctgtgactatccagtctgaagaagaaaaagtgaggtgtgatttattaactttactcaagtatggaattaatttttctgagaaaaagtatcgtctgttttccaaccacattataggaagaattattggaaagctttcagatttaagggagccaaaaataatttttttttactgtggaaaatgttgggtattagagttgttagtcaccccaatccatggcacccctcatcgaattctttcaagataaggttggagcttggcttcagagagagcatcataagctgttagggagatttgtgcccatcatttgtccttaccataaagacttggagaatttaaatgactgatgactagcaagctggacctagcacacatgtctgattgatatgaaagtgccctcttgaccaaaagatgtatgctttttcaatcttctctaatgtgttgatatgtttaagtggacaattaaattgattcagcatagccaatagtagtagtattttctcccccaaatattgtgtgttacaaagagataactcatttttggtcaactggtaaagtgtctcgtgtcttatcagaggctcttctggcatcatggttttctctaaggccaatgcagctaacttttatttctttaaacaattcacgtataacaatctacacagaccaaacaaatcaatttcctgcacatctctttggggtagaatattttgcctgaaaaatttatttctaagtatactgaataaaatctgttcagagcactaatataaaaatagcacaaagtctggaaatgatttaaacttctgccacaggatcaggaggccagaaatggaacagctgacaagttttacccaaagggaagagaatgtcttgtcttataagtgaaacaattaccttttttggtagcaataataccattttttagatttctttgtttggtgattataattctgttttcttcaaaaatttatcttaaaaatgttgtgtcccaaagagtgtgagaaaaataacactggagcttattgatattgatttatggataaatagtgaataacacattttgatgtcaattttgaatatggagacacagaaaactcaagtattagatagtcatttctgtccttagtagctaacaaaaaccacagagaaagaaacataggcacagctgtattttttaaaatgtatggaattgattaaagtcattgagttacaaaaccaacaaaactatacagaatggagaatgttgtggtgctgctccagatggccaatttgacttgacagagtcattttcatggtggaccagatgactttcagtaaaatattcatttacacagaagcattttggcaagtttcacaatatttactttaaatggacatgccctgagtctgtgaatcaggtttctaggagcacaaaaaaaatactaaaaccttccatcatgctatttatttagtgtcctgggtcaccagctttatagcattcttattttgtttgggagcttgagaaatggctcagagtttatgagcactggctcacaaagtttcataatttcaatttcaggggacctaatgctctctttggcctccaagagcactgtatacattcaagtaggcaaaacactcctgcatacaaaaatactaataagcaaatcttttaaaagtttgttaaactttatttgatataaggaagactatttttccagctctcagcaggcactccttagttgcttttagttctttgtctaggattcagaccttatgagttttcccctagcctgtttgttggtgtcattctggttcaggtttcatttgggcagtcatgttattgaggtttcacgggtgtagcttctctgacacttctaggagacaaaatcccagcatatttcctgtttctatggatctgatgctctttctcctcccacttctgctatgatccttaggtgtaggtgtgcaaatgtagatggattggccaccacactgtcacttgctctctgaattttgatgtgttgtggttttctgcattgttctccttgcatttctgcaaggagatatttctttgatgaggggtgtaatagcaaattgttagtcctgaaattatatatacacaagtaacattctatagtcggagcaggtgtatttatatatttagggtgcatgagaagggctggagagaggaaaggagaggggaaaacatgtaattccattttaatttaaaaatatttaaaaattcaaaaagaaattgtattttgttttagctattttattacaaattattattattattattattattattattattattattattgtgtgtgtgtgtgtgtaacatggagtgtatgtggagattcgaggacagtttgtgggagttgattctctcctttcactaagtggaacctcacactcaggtcagcaagcttggtgatggcacctttatttactgaggtgcctgcattttcaaataaatgtgttgaatcacagagtacctccaacttccagcactacatgctataataagcattttcagagatgctttcacgtgaccatccaatagattatctacatagtacttacacaatggaagtcatcagtgaagcaatattttagagcagctttattgagctataactcagggaccattagttcatcctttaaagtatatatcccagtgctttggaatattcagaatccaattatcactgctacaaaattgtagaacattttcacacctccagaagacttcttgcacctgtattttaccttcaattgcatcaactgaagctcttgccagttattcatgcaaagaaaaaaaagcttgtttgcaattcattgagtcttgaaataacttcattttacatatacaaacaaaacctgtgttcagaatggtttctgaattactaaatttttctggaatgcggctgccaagtatatttaagcttattatatttagccattatgcttagatgttcaatacaaagtccctgcaagaagcaggtgtgtgtctgaacatttacattttttttacttttattcatgtgtataagccatatgcatatgtgttcaggggctgcagaggccagaagagggcattggatgctctggagctggggttagaatctcaggtgattgttagcttcctaatgtggatgttagcatctgtgctctcatccttagaaggagcaacaagtgtccttaactcctgagccatctctctagccttcagatgagtgatttggtccctgtgtttaatcttcatgagttgattatgggtaggaacaggattctattattccttagtatagtcatagttgaggaatgagagcctttttcattttttgtgtgtgttgcaattaggattactgatttgtcaaaagttggtatgtgtatacatgatattttcaaagtacaagtgttcaaatgttttataaaaaggcagcactgaatcagatcaacccagagccagttacttatctaaaatagagaacaagtccatgagccacagatggcctgctcttgatagtttttaaaagtcacccagctccggggaaaacccagctgacctgagcaagtaggagctcatggaccacagtctgacagctggggaaccagcagaggacccaaccagaccccctgaacgtgagtgtcagttgggggccctgggtagtctagcttggggcctagtttgtgaactgggttttttggagccagttccctatggagggatactctcttagcctagatacacgggggagtgggagaggttttatgtcctgccgaaaatgatgtgacactttggaggccttccccattggaggcctcaccttccctgaggaatggatagggagtaggatagggggttggtggggggactgggagaatgtgaggaagagggaactgggattggtatgaaaaattagatcatttttaatttaaataaaaattaattaaaaaagagaaaaaaagtcagccagctccacaatgtaatggaccagattggccatacttatattcttttgtatacagtaatttaaagagatcttttttctaggtgatggcatggtgtgtacacatgtgtgtttgtgtgtgtgcacatgcatgcatgtgtgtgtgtgtgtgtgtgtgtgtgtgtgtgtgtgtgtttataaaacacgcagtggggatctgacaggtagtgccttttttgtctctgtaaattacatttgatgttgttaaagctttcttttccacctggaagcccgtagggaaatgcctttaaagaattaattagcctacactcttatttaaggagctaacatttgaaaactgtacaagaaactacataagaatttttattttgaagttaatctttggatatgtacttcatgagaaattcatattaaatcatttacacattcacaaaaagcaatattgacaaaaccctagtagaaaatagttatttatacttttatgaagcttgtcattaactaggatgcacataattttggttctgtgtactgtggtatgctttggagatgtcttactgccatacctccctgagtttggaagcgctcacctcttctcactctgcctttatgtctgtttagtctgttgctatagcagaatgtgcttcctaacacttggctggaagctcagacttgtgcagtgagtgatagacatgacaactttgcctcagccactggccaaagtaaagaccaatgtcagtgaatgggatgatcattatagtcttccccaaatcctgtgtgagctacatgttttccaagctgaaataaaaaggaaatctaagctggatcataaagccaaatatgttactcttagaaccaagaactagcgagctgacatctgattcgagagcacgtatgatggaggagaggaacttttatgattcatatttctcttgactaactgccaagtcttttgtgactgactgaccaaatgtcaaatatcctttggaggatttcttgatgttttcagtcaatctgcaaatctcattactcttctaacaatctttccagacttcttttgtatttgcttttctatttcctatgtggtttttgagaatgttctttacctaagacaccatttcaatgcatttatgtagccattagagacattttctttgaaatataatttcaattaaacatttataacttgatggtgacttcttaatttttcatccataattgttattagtacatacttatttgaattaataagcattcttagcatactgaatgaattctgtgggattatattgttgtgaactagatgaaacatgtgttttattctcagtacctttatggagaaaagttgtggtgaagtgttaggctttaggatctcagtggatttttaaaataattacaaaactcattaataataataaaagaaagtattgtacaatttatatatgcaatataccaatatatgattatctcatatatgtctgtcctgaatgcttgttccttcaaccttatattctagttgccacaggcacaaagatgtctgctgtattttcaaaggcttcgtagaaggataatagcaatgtctttttaagaccagagctcatgcttttcctcttatgtaacttgaattcctacttctgcaatgtaatttcccttttacaaattctgaatagagaccatctgctcaccatcttactctctttttatctttgccaaatgtcattggcagaaccatctcctctgccccttatctctcaagtctgacccttaaagagtcccactttatctttgtctgttgtagggcagagtgaacagcaatggcttctttatctcagcctcatcgaacacatcttcttttggctctctacatttagctcccaatcctgggctccacctattttcatgccatgatgtcaagctctgagctactttagagattcagaaagtggtaatagacaaagccaaccattcttgaggtagctagcctctttgttttagagattggagcctggagtcattagactatccacaggctcagtggccagtcagagtaagacatttctgaccactttcctcctaggataccttgcagctattatctttacttgcttcaggttttgagttgatgtctatgggcagcctgttgaggtatgattctcatgaaggtaaccactaaacagtatgtgtgtgcacttattttagagacactataatttttaagagttacctagagtaatgtcatgaagcaaagtttaaaagtgtgcttatattttgtacactagtggtcttactacatttatagcaaaggtaaaataaaatgaaagaaataaatacctttgttcttccatatatttgtgtgtgctttgttggctatgtttaataagcttttatgctcttttctgtctcttgtgtggaattgcccatagcaactaggacattaactaagttatcgagctctgtgacccttctgtattctgtccaggagacaattggtcatcttgtaaaattgtttggtgtttttacttaatgaagttcttaatatctttttttaggaaatgctgttagcagtagagaaattttggttttctttgtcattgtatcttaaactctgtgtggtcacattatttaatgggtaaatcttatgttagatttcaactacttctctcaccaaacaacttatgagatcatttgccaaatacaagggtgtgaaatatgagaatgtgggtttcttctttatcttctcttttcatgttgattttgttttatgatcaggtaagaatgacacagacaaggaataatgaaaaatataggaaatactatttcttaaacttttgaaaaggataaagtctgaaaattagtttaaacttgtgaaaaattggttgaggctgctttggaaaaaatgcatggcatgtagttactgtaatgaattagaatattcatattattagtgtctggggttcaaaataattaaggagaattagatcttgaatgaatattaccacaagactttgtaactcagagttcttagggtgaggtcactcttgcttgctttctactgcttcggtaaacaccatggccaaaagcaacttgggttgaaaactggcttatttgtttgatacattcaggtaacaatacatgatggaagacagctggggaacactccagcggggcaggaacttgaagtagaaatcatggaagaatgctgcttaatgacttgttctcatctctttcagctgcttcatttatgcagcttaggtttctcttccaaggagtggcactgcttacagtgggaagggtccatctacatcaagtagcaatcaagaaaaagtcttgaaaacatgtccatagtccaagctaataaaatcaatgcgtcagttgaggtttcttctttccaggtgtgtcaaacgccacacagtacacagccacatttggaaaggaaagcaatacacatttatttccccttatttgtactccccccttcaatagtaactgcatcaccatcaagggtatttctgggccacagaggaccagggactcattatagatagattggctagtgtgtgtgaatataaaattgaatttagtcctattttatccagattaagctcaagtctttgattcaccaaactgtttcattgggatgctagaaataaaaagtgtttgatgagattggtccttgaaggagtcttggagactgtctgttttcagcaacaggaataggccaacgtttgcctaggggttgacccacatcacttagcaagcacagctgagaattggcactcagctctttctggaccctgctgcctgctcttcctgtctcaccatgttgctctctgacaattggctattttctggacagctgcaacttcctttcttccaggcaaaaaggaataaaatctgcaccactatcaaacaaccaaactccccccaaaatattacattataaaacttcctcagtgtacacagatactagtacatactatgttaccacatgagcttcagtttaaagggcaatatttagttatgaacttcataactaaatgattttatttctcagtagtcaaagaaccgaaattattactgtatgcatatatacatatgtatatatacatatgtatatatatatcccactttttcagaattagttatctcttatatttagctaagatacctgttttgaaaagagtatctgttgtaaataaattattatacatacaaaattagatattgtggaataacttgaatactatgccaaatttgctttatagtcaaggctagggttacattgactatttgaggctattattttttaatttgtattgaaataagatgatatctctattggcaaaacacatatttgaaagagttgatatgcattgaggcttatgtgaattttacaattttgaattaaaaactttcaaatttgtttgtgtgtgtgtgtgtatgtgtgtgcatgtgtgtgtttacatgtaagaatacccatatacccatacatgtaccagtgcacatggagtctacaaaaagggcttcaaatcccctggagctggaattacaggaagtttcgagatgcctaatgtaggtgctgagatcagaaccatagtcccatggcaagggcagcaagctctccccccatttattgaaaatagctttttttttgtctcacataatacatcctggttacagttttccctccctctactcctgtcaacctcccctcccatctgtatctactccctttctgtctctcattagaagacaaacaggtttttaaaggataatagtaaaagaaaatgtaatataaaaagtaaaataaaaaggaatacattggaatagggcaaaacaaagagaagtgaaagagcccaagaacaggcacaagaaatagatatagaggcagagaccaactcatttgcatactcagaaatcccatagaaacactaaaccagaagtcataatgtacactctcaagaatactctttccattgtctcttctcagggttccatgcacatgaatgagaggattcaaagagacatcccatttggagctgtgtgttccaagatctcttattctctgcataatgtctgattgtgggtcacggtatttgttatcatcttcagcaagtgctcctaactactgaaccacctctccagatcccttatatggttgtaatgtttcagaatcttatacattatttaaataaacaatcatcacatcatcataataagacagtaatgagactttcaccttgtattagaaaataaaagatgtctttaaaatggaggaatcatgggatggagagacggctcaacaagtcaagctgcaccatgtcatgcaagtgtgaagacttgcaagtgtgaagacctggcaaatgtgaagacctgaggtgcttctctagaatccacatggagccaacagtgtacttctgtaattgcagaactccaatgaacaattcctgggggccatatcggccagctagatttgtttgggcattaatgaacaagagatcctatctcaaacagaaaccctaaggaaagaaaccccaagttgtcctctgacctccatatactcactcactcactcattcactcactcgctcactcacctgtgcttacactcattcacatcacacacacacacacacacacacacacacacacacacacacacacacacacacaccccacacacaaattttcatatgcactaaaatcaagaacacagacagcctttcattctgggtgttcatcatttagatatgtgtgagatatgtgcatgtctttagcttcagtattgtttataatagaaaaactggtttgaatcttaaatttttccacataatacactgtttaaatacattttcatattttccaaagagaaaacaatgcaaatattagagcattttgggtgatgtaaaaatcaccccaaattagcccgcctgcccagcaggtcaggtatagtcagtcgcctggagaaacagttaattctttaaggtcagatgctcatctaagagatctggagacagcagagcagaattccccaggctttcttttttcctttgaaatttgccctttgttgactcctttctctgtctcagagagaaaagaaaggctttgagatttgctgatggctctaccacagagaacccaacacaggggcagggaaaatgcaagacagtgcacctttttgtttccttttgttttgttgaactttttattccacaaacctgtttagtatgctgtgaaagagtagtctcaggacatggcccattgctcaatgcctttctacaaggctcttcagaagcctcttctggctttagagataagattaaaaattttagtttttctgtctggacttactagactggaagcaaggcaaatctcagtttgcattgattcatcaccagttcctgggtctgcgacattgcaggcacgaaagagtttatgcttagtactaacatatggatgcattagattgaacgcccactgatggtatgaccattccctgaatgatagacacttttgtcatctgttttcttgttgatggccattctgaccttagtgagacaggatcgcatgcagttttcatttgcatttccctgatggctgaagattttaaatgtctattggatgtttctatttgttttaatttgcctccttttgaagtttggggtgcttatgtttttgaattctttgtacatcctagatgttaatcctccctcagatatataaataacaaggaaattttttcccaatctgtaagctgtctcatcactcatctgtatcctttgttgtgcagaaactttttaatttcatacaattccatttgttaattcttgctattcttgctattatttcctaggctgtaggaattctcgaaggtgtttgtatctcaagagtttctttctttctttctttctttctttctttctttctttctttctttctttctttctttttttgtaagctatctcagcattttggcctgagcagtgaggtcttcactcttctggtattaagttgagaggccccagattatgtgtctttatcatgaggttactcaccttgcaaggtgcttcagtgcaaaacacttaataaaataggcttagcacctttcaccccaatggaaattttctcccactttatttttgcaacatgtttttgattcactttaattgttacatcattctgacctatgtgagagatattttcatatctgctttgcccttttgttaaagctccacgccagcttattttaattctatgtagagtctagcattggagccaacataaggtaagaattaatgcctatgatcaaattgaatggatgatggaaatatttgatcatgagcaatccttgtacaagagtatcagcatttgaaaacagttgtttaagtaacagtgggtctgaatgaaacaaatgggttatcaaagacaccttggctgttaagactagagaagaaaagttaccatttgaatggagaaaaacaaaagtacagatgttaataaaatcacactatgaattttattctttggaaaatatgttaaatggctacacatactttactgttttaatgattaattggggaatgcagtcttttattttttatttttcagaatttatatgtgaaccagacttttaatttgcttgggtcttaactgtttttttttaattagcttaatcatatattgcattaattaacatttgtaatttatgtttggattctgagactctcatcaaccaagagtctctggctcagagatgtttctgaagcctggggaagagctctgtagctgttttctgattgtttggtgaagatggacttgtacattatgctggtcagccatgttcctcggcaagggatagctcaaaagggagcctctgatggttttcatgagtccatggaacagccggctgcgagcagcagggcgaggctctgagagggctgtgcgtatggtttcctcgggataaaaggggtgtggactcccgccttcacaggacagaaacttggttcccaagttgaacaagaatctgtgaggtggtttacttcccaaactggccccagattcagttttcctggcatccctcaaccatggaatcctgtcttttggctcctggtgacaggcagcctgtcacctttggttctggtgtcatgtccaaggaaatgctctgtgccatagggcatggaaagacacagttagaacaggagaactgccaatggcagaggctccacaccaggatgagcgcaagggaagtggccgtaggccactgtggtcagcctgagcatgcttccctttcataacccagacttggatgactagatggtgcttatatttggctggctgtcctctggggacattttaaagtcctgccgcaggtctttcattggcacagtgacgctggtttagatccttggccaagctgcctttgagtttttatactaaggtaagccagccaacatttaaaccctgtttctgatgcctgcccttatgattaaagtaatgcaactcatacaggctcactagtcaccatgccgttacattataacagagcttctgcttaaaacttaaattcattctatgactcagatgtgtagtgtcttcagcaatggggcctttccatcaagttctagagagcagccaatggcattggcagtagctgtaatatttagggttctgtggcagttcactgaccaaaccctccaaaagacttaacccactgttggcactgggctatttacttgttagtttgtggcatctagcaggaccattgccactccattatcaggtaactcaaacttttaaacaaggaaaattgtccactgtttgtggtggtttcagaagaattacttgcagtttacctcaacagtcttggcagcttcattcactatgaataattgcagatgcataggacaccactaagattatatgcaaatattgctaaaagaaggcgctctagaaaacctccaagggttagcgtctatactacacaatctcttctccattttgatctctacctctctgtctccttacacacattcccccttcccttttcatcctgatcatattccctattgattttaaagggtattcttctaactttcatttggcaatcatcttaactcatatttcacaactatttcctagttatttactgttacaagatcagtttggagcccttctcacctcagatgcatgcagtcggccaggagcccaaagctatccccacttccattttgcccaggattgcaaagagctcacaccactagcctagattggttaggcttttgacaatacggtcctgttgtcttcagaacacaccaatagaaagattcacgtcatgattccttttggggctctgattaaaataagaaactgatttgaccttgttatttgccttcccttaaagtaaaaataccatagttaaaggaatgaaggaagatgagacgacaattaaaagaggagcaggctgtcaaagaactcattgtctcaaaggaagtagagatatacacacttgcacaagtgaaggctgagtttctgttctgcctggtccggatgctcttcagctccaaataaacacactgaggctatattaattagaatctgtttggccgaatgctcagtttttttactggctatttcgcccttaattattaacccatttctattaaactatgtattgccatgaggctgtggcttatctgtaatccagcaccttactccttcaggaacatggcatctcccttgcctcttctctctgcctctctttccagaattctccttgtctggtaaccctgcctatactttctgcctggccactggccaatcagcattttgttcatcaaacaataagagaaacatatatacaaaacaaacaaacaaacaaacaaacaaacaaaaaaacgcatcccccatcagagaaggggaaggcaaatctctgcaaaggtggcaggacaattatgcactttgcttgtggctgagggaggataggatttgctgctgaagtggcagctctagctacccttagagagttagaagtacactccccagtgaagaaaaatgtagagaaaatggtaaagtccaatagccattcaagcagaggaaggaagaaggttgcagaaaaatgttgttaagttatattattcattattttgaaatttccatgcaattgtaactccaaattagtcaagtaaaatctggactaacggctaagcagttcctgccacagatgaaaaagaacttggttaaacctcactgcttggtgacaagtaagggttatgaagtcaaattgtccgtattttaacccggctgcttcatttaccaacccctgatcttggcaagtaacttgacctcttgatactttagtcttcttcagtgaatggatggtataggagaacgtcacaggacttgtagtacaaattaatgtattttaaaaagtgttcacagaaagccttgtgcaagtgggggctgctgttgcccgggggtccaggtgcattgcatcttcaatgtttgaagtgtgctattcatgtaattcagtatgaaggttcgctagaagatatggcttaggtctgctacagtggtgaaatatgattttttcttatacatccatgtccagcacacagaatgacacaaaataactctgctggcattcctatgtgaaagtttataaccgagtaccacttaatgttattgggactatcttattttttattatatgagcaagattgttcaaccaagggacatcagaaataataaatagttttaaaactttagattggcccactggggtaaattgataaaacaatttaggatactccagttaccctcaagccctctaatgagttctggagcatttttgaaaaaataacctttgatactgaattgccacaaaacaaagccaatgttatcttgttataaatatgtacatacatttttcccactcttttatttcttaaaagtttgctctaataaaatttaattttgaagctttgccaaagaaaaaactacagatgggctatttttgttacaaatgataaaaacaaatatgttataatgttaagtcaactcactgttgtttctaaatactttgaaatattacaataacctccttaatgttattataatcatcttttaatcatcttatcaaaatagccttaggaactttttgaaactgttctgataaaaatatagaaacagtaataaaatgaaaatacaacacgaaatagtaatgcatttcagaaaatgtcgaagaatattgtgtcaaaaattgcttcatttttttgaaatgtggaatggtttaaaagctataattgacataaaaagtgggaaaaaggcaaagccatcaggattagttcaggaagtcatagattataataggcagaatgaactcaaaatattttcagtgtatgattcagagttttgagactcagaatcatgatgaccccatggtcacaagaagcctctgcccatgtcaacatatgtctatgtagtgcacattcaatgatttattctttatctcatttttaattatttccttcaagaaagtacatgtaaaatagaactgttgtttccacagaaccattcttccacgaacactcccgtagttgctgccaaatatttctgcaatagtttaaaatgtgtttcaccattcaccatctgctttttctctaatttttcaaaacatggaaatagctgaagataagggaaagttctctgaaatgccagactgtgctgtataaatataagttataatatatacagctatgtcttgggaatgcaaactactaatttgtaacattgaaaagagtagttgctattttaatagtaattgtggtttctagtacattaaagccagtggtaagaacaaatgttttcaaaaattataacttgagaaactcaaaaaaatcataacaacaacatcaacaacaaaaaaccaacaaaaacccccaaaaattcagtaccgaaacaatcaaacaaagataactggattaaaaaatgcctggcacactattgattgtgtgaattagtgaagacattatagaaaatagtatggagggtccgtgaaaattaacactagagctaatgtttgagctattaaccctactatgggtagatatccaaggaagtgaaatcagtttgttcaagaggttctacactcctgagcattaaaaataagtttgaggtcacactgaggcaacaactccagctgaagagtctggacaattcgagacttcactcaagatggtgtgtgtgctggaaagaggggacacacggagacaaggacatgactttattctaactcagggggcaactgcttctttctcacattggctggagtcccacatcacagtcttactcaattggctccttttaaaagaactggcacatgggaagtgaagggggaagggatcagccactttaattggagaatgtagtagggcctttgtgtaaacaaagggtgtactgggtggagagattaaagcacttgcataaaagtcttacaagatgagggagataaaaagatttaaattcctccctaagcacaagtttcaaagtatttgatagaagtttcatattcaatatttcttacacatgttcactgaaatgttacttttaatagccaagaaaacagaaaccaaaacctaaatatcatcagtgatgaaaggataagggaaaatgtagtacttattaacaacagagccgtatattcagccataaaatgacaaacgctttgttgtatgcagcattgtagattattgtactaatgaaagccagggacagaaagagcaatacaacatctcacatgtatggaacctgaaaatgttgactttcatataagaaagcagaatagtagttcccagagcctgaggagaggaataggagagggatgaggatggcctaatcaatgggtactgtgtcacagtcaggtagtcagaggatgatttcaggaaccatttcacaccatagtgactgtaggtaacagtaatgtacagtgcatttcaataaactagaaatggagaatttaaagaaacagtgtttgaggacataaatatgcccagtctcatttaaaacatgcaatatgtaaaatgcatcaaacatcatgtatgtggagccaaccaggatgtatgagttttatgtttccacccattagttaaaaaaacaagaaatgtaaataaaataaatgcaaagtgtagttttattaagagggtaaaatatttccaaggtaaatataatcgattttattcctatatagattagaacacacatttctatttctttagaacctgccactgtttagcatgctgaatctcttgctataatgtgatggtttatacacttcaaaactattatagcaagtgattaagcatgccttaggattctgtttaagcacagtgttccttctgggaaatgaggctggagtacatggacctacacagatattaatacatacatgtctgtactggtttgtgagtatttaagtaatgtgttggataaagagctctagtcttccaaattataatttcttttttaggtaatttccctttcattgctctggaatttcctaaaggtggcttcatttggcactacaccttttgtaacttgcctctgcttgccatgatgttcttctccggcattagatcacggccttgcttactctgaagacaacaatactgccctttcttagaactccctcccatccctttgttcttctccggcattagatcagggccttgcttactctgaagacaacaatactgccctttcttagaactccctgcctgtctacctcaaatctaagatggttcaaggtgatttcatgtaaggtgatctcttttatctgacaggaacacattcttccattactggtgtgtgtgtgtgtgtgtgtgtgtgtgtgtgtgtgtgtgtgtgtgtgtgtgtgtgtatgtgtgctctttgtttgaaatcagaggggtagttattaatcttcagaaggcttgatttaaagaaattcatcctatttcgaagttacctcctttgggtaggtacaatagggtaatatcagttttacctagagtctttttaaattctagcttttattccttactgaaaaatgtatctattagctcatcagctactcatcaagatgtcctcacaaaggtcgtgctaaatgtctcatatgcatgtttaaatgtcaagagaagaggagaaccccagcataataccatccacgacagggaagctaaagagaatatctttatatttttcaggtagtaaatattacttaagcaatgtacacatattgttagccaaaagaaaaaaattgaagtcaagaattctgtctattcggcagcccacagattgggaaaagatcttcacctcatcagacagatggctgatttcaaaaatatacaaagaactcaagaagctagtcatgaaaacaccaaataattcaactaaaaagtgatgtgcagaactaaacagagaattctcaaaagaggaatctaaaatggctgaaagacatttaagtgctcaaattccttagccatcaaggacatgcaaatcaaaacaactctgagatatcatcttacacctgtcagaatggctaaaatcaaaaacaccaatgacagtctatgctggaaaggatgtggagaaaggggaatgcttctccattgctggtgggagtgcaaacttgtacagccactttggaaatcagtatggtgttttctcaggaaaatgggaaccagtctacctcaagacccatcaattccactcttaggcatatacccaaaaaaagcacattcatactacaaggacatctgttcaactatgtttatagcagcattatttgtaatagcaaggacctcgaagcaggttagctgcccttcaactgaagaatatctatatctatatctatatatatatagatatagatagaagatatagagatatagatagaagaatatagataggatagagaaaatgtggtacatttacacaatggagtactaccaagcagggaaaaaaacaacggaatcttgaaatttgcaggcaaatggacggaactagaagaaaccatcctaagtgaggtaactctgtcatagaaagacaaacatggtatgtactcactcatatctggattctagacatagtgaaaaggattaccagcctacaatccacacctccagagaagctaggaacaaggaggaccataagagagacatacacggttccccagtgaagcagaaagggacaagaactccagaacaaatggggagtatggggtgagggggagggatgtaggagaaagaggaggggagaaaaggagggggggaggagagcatgagggatcaggaagattgagcagtggagacaaatagaggagagcaagaaaagagacacatcaatagagggagccactataggtttaaagagaaatccggcacttgggaattatacagagatccaaaaggatgaccccaactaggaccctaagcaatataggagaagctaccttaaatacctgtcccctataatgagaatgatgactacctaaaatgccatcatagagccttcattcagtagctgatggaagcagaaacaaagatccacagctaagcactgagcccaactcctggaatccagtttcagagagggaggagtgaccaacaaaggggtcaagaccactctgggaaaacccacagaaacaactgacctgagcaagtgggaactcatggaccccagtctgacagctctggaaccaacataggatcaaaccaggccccctgaaagtgggtatcatttaggatcactgggtagacgatggggcctctggcagtggaaccaggatgtatccctaatgcaccaatggatttcaggagcccatttcccgtgcagggacactctcttagcctagatacacagggagggcctacgccctaccccaaatgacttgacagattttaatgatccctcatgaaagacctcaccctccctggggagtggatgggggatgggatgggggaatctttgggggttatgggaggatgggagggaaggggaactgggattgacatgtaaaataagactgtttctaatttaaataaaatttacataaaaagaatgctgtttattggttaacagtgagagactatgtgggagactgatgtgtttgtaaaactgatcagcatataaaatgaaagccttttatccagaataaataaaatgcttggaagtaaatgtgaacaaatagacaaaacagcagaaaaaataagccttagtagatggtagtcaatccattcataaatctatgaaaaagttctctaatatatttagttgcccgggaaattgtaaattaaaacccaaatgaaatgccattccataccaattgattggctaaagtgactgtgccaagtgttggggaagaagtagaaagcctaggccccttctccgttactgaaagaagttgtaaattgctaatgacttcccaagttacttgttaggatttagtaatactgaccatatacatattctctgacctaataactgtgaaaattcatcatacattgccaagaggaaagtacaaaaatatttctagcagtcctatttatagtaaacattgtcagcagttgccaggaccaccccagagttggcgattcacagacatactctcaagatccaacatgattagtgctatgttccttggtatggcttatcttagtgaaaatatacacaactgaagcagcacaaggaaaatgacttcaggggcaaagtcaggagacaaatttcatatccccagagtccttttcaagtggaaaagagcagaacatgtaccgccaccatatgagagctgtctatcagggaaatatggcggagactcagtgtcaggtgtatttttccccttttattgaaaatagattttcccctcgcacaatagatcctaattgctgtttccccttcctctacttcagctgctcttcccctccctcctatccagatccactccatttctgactctcatcagaaaacaggcaggtttttaaagagataataacaaagtagagtatagcataataaaacaattagcacatctgaattggacaaaacaacagaaggaaatgagcccaaggaggtacataagaaacagagacacactcaggaatcccatcaaaacactaaactggaagccataatatatacacagaggacctgtgcaggccattgggccaaacattcaatttgaatgtcgttttatgttttatctcaatgaaaagtttacttatgagcatgtttatcttataaaaaaaagtaggtagaaaggagaaacatattacttaaaaatggttagaatttctaatagttttatgctattaaaatgaaatagtaaaattatgaacaatttagtgaatattatgtcagaaagtttactgagtgtgccattacagagctttgtactgtctacatggagacaccatatacaatttctactcagggcttgaaatgtggccatttcacactgatgcatcctgtatgtctattccatccgtagttgtcatagctgtgtgttctaagcacaaaatacaggccagtctcaggattctcaatatagacaatcacatcttttctcaacattgtattgttgcaggcacaacatgcactgctgagcacatttcaaatacattgtttaaagcagtctgtcttcattttaatataactacccaatattaaaactatatatgtggctcatatggcatttcatttagtggtagtttaaataaaaaaaatgaatagacatattttctatttgattagtttctaaaaaccaaactcttaatcaagttgttcttgctggtcctcaggcatccaattccataagccagtctagcatggcatctttagaactcctttggctctcaggtcctgttgcctgtttaaatgtttatatccactgacaaatagccatatgaatcacaagtgttaatgtcttattttcaattatcctgacttatggcaacatgtagactaaaaatattatttaatagaactatttaaaatattatcgttcctgggtcccagcctctaattaccgagaacacagtgaagacagtgagagcatgctaaaagggaactaactatacttgcacttgatataatgagcacaagcacttctgctgccagggctgttgtttctatgtgcttcccctccactgaaaatgtcttgttgggctttgggaaaagtttggaaacaaaatccaggatactagaaatctgtttattctgctatgttattgatgaatcagtatctgtagtcaacctcaccagttaggtcaaactaagtctcagtgtaagtcacaggtagaaagcacttcctccagtacttcatttccctttactccaggtgggactccgacaatcaattggcacaggtcagctcttttttagtttatttctccttatcatggcagtgtttccagactttcaaacaatgaaccactctctcaggcatgttcacttcagattctgctgcgggcacccatggaagaagtttgcttctggtttagttccatcgtgaactctgctctgagttgggattcagggtgtacgtgggcgattgctggcgtcccacattgagagctgggatactcagtcatcctttccatttccttgctgccaccagctcagtggttctattacactgctgttactgctggagctgttggcatcagtgcttacatttcccatgtcctggagtgacactgacgctatatgtataccaacacagcttggatctttaaccataaccctttcactgcaatattcatgctaggggctctgaggacatttttggacaggcacaatgatacttagacctgccctctcttccagctgataatcatatcctttaactacatttaagtcccctcacagttctcctccattacagaccagctcgtttttataaagctcttgttagcaccaccagacaaaacagaaattccagttaaattttaactttaaaaacaccatcttagtcaactctaacaaaaatattatagatgagtagcttaaaaaccatggaaatttccttctcaggctggggagataatgaaatgcttgctatacaaccatggtaacttgaggtcaatcccaggacccacataaaggtcaggcttgccagtgaatgcttgttaccccagatcttgggagacaggcaaaggaagacacctgggactttctcgacaaagagtttagcctaaatagcagcctccaggcaagcaggagatctttttcaaaaaaaaaaaaaaaagggtggatgtctcctgaggaatcagagggacagatgacctctggtctccacatgtatgcacacttaccagcacccatacctgcacaaatacccatatgaatacccccccaacacacacacaggaacaagcacacagaaacacccacaggaacaggcacctatgcatgtttacatttcatagttctttagagtaagatttagtgtctagcaagggttccttcctggtttatatttattcttagtggtgtgtgtgtgtgtgtgtgtgtgtgtgtgtgtctttaatgatataagataaaggtaatatttgtttctattgcatacgatattgagtttctctatcgccatttgttgaagattaggtttatcctgtttccagtacccttttcaaggaagaatcaatcatatattcagttttatttactgacgccaatgatataccattgttatatataccatttgttatagttttgtaattttttgtttgtttgtttttcaaggcagggtttctctgtggctttggaggctgtcctggaactaactcttgtagatcgggctggcctcaaactcacagagatccccctgcctctgcctcccgagtgctgggactaaaggcatgcaccaccaccgaccggctatggttttgtaatttgtgcaatcagaaagtatgaagtcttcaactttgttcttcttgaattaattcagctgtttgggtttctttgtgctttcatataaattataggattttttttgtcattgagattttgatgagaatttaaactgtgactgattgaagctgtatgaacattttaacaattttagtcctttaaatccacaaatagagatgtcttcctatatatttgtgctcacttaattttcttcactcatacctcacccataatttttggagttaaaaaaattcatctttgatgggcatggtggcacacaactttaatcccagcacttgggaggcagagacaggaagatctctgagtttgaagccagcctggaatacaaagtgagttccaggacagccaaggacacacagagaaagcctgtctggaataaccaaaaattaaaaccaagaaaaataacacacatccttggttaagattatttctaagactttctactcttccatgagaatgaacatggaattatttcccagctttttagaattctcccctggcagtgatagaaagacagttgatttttgtcaagtcttatatcctgaaactttactggtttaaaaaattacttctatttctagtttcattctcttgttatacaaacagacactatgatcttttaaaagctgccgaggggaggtaaggatttatttggcttatacttccaggtcagtcaatcattaagggcagctggggtgggaattcaagcagtaacttgaagtaaaaatcatggaggaactctgctgtttggcttgctttcttatggagcctagagccacctgctcaggaaatggtgtgacccatacttgagctggtcccccctacatgaaataagggaattaaaacaataccccaaagacatgctcataggccaatctgatctggacaattcttcattcaagtctttccttgcagaaaattctagcctcaaggtgacagctaaagttaagtaggatggtgagctctttagaggatagaaattttctctctatataaggtcacatcatcgttaataacagtaaaagataacttcaccttcttccattccaatttggatgtctctaattgttttccttgtctaattgctccactaaggactctggtgctatactgaatgaaagtggcagccatgtgtatttgtgtcttgcttctgattggagggaaaagctgtcagtttcactacctagtaagatgttgggtatcagttaggaggcatgggcaatctatggggactctggtactggatcagtatttaaccctagtataccaatggatttggggagcccattccacatagagggatactttctcagcccagacaaacgggggagggtctagaccctgctccaaatgatatgatagactttgatgaccccccatggaaggcctcagtctccctggggagcagaaatggaatgggataggggggcagaggaggggagggagagagaactgggattgacatgtaaaacaagcttgtttctaatttaaatttaaaaagaagaaaaaatgtgtgaaccattttaaaaaaggttttagctatggggttttggtatatggctttgcttatggtgagataagtttaagtgcttttattatttaaatgtaattaattttattaagcaccttatctgcatctatttcaatgattctgtgatttttttcttttgttctatttattgggtgacttggattgattatttgcacgtttaatcttagttgtcttcattgttccctaaacaatttagtgtaaacaattttgttttatacagattctttttatatccacaagaagaagagcatttatttcataagaaagctccctcacctaccaccctctctgctgcctttctctggcatttcttttctttgttttatctcattcttactgctgatacatttttttccctcagaaggatcaaatatcataacagtcttaaaaatgatctttttactgttgtgaaattcacatataaagtgtttattgtttatgaacattcaaccacatgcatgaatgtatgtgcacacacatgtgtgcaaacatgcatatacatttatttctcttagtttctcatgggctcatattcccaaggtaaatgaacccacatcattaggacccaggaggtgaaccaagactcgtaacaactcaggccctcttcctgtactcaccttcagtcagcatcttttatttcctcttttatttcctgtgttaagcataggaaaattttaaaccatagaagattaattattcactttatataatttgaaatatatagtataaaacaaactaattttgtttttttttgttcaacactatatttgaatgttttcatcattgtgtcattatagaccatttatcattgttgctgtgtgattataataaccacacatttatccattatgctgttgccccatatttgagtagttgccatttttctcttttaggactagttctggagtgaatactcttattcatgactttcatgagcaaacagacagattaattacagtcaaattaggtttgtctaattctctggcttatttttggtcttttgttgactagcttggtctaatgtttatcaagactctatgaatgaaaagaatgatatgccttttgaattgcaatgaatgatggacttggcaagtgtctgtcagatataagtttcataaaatattgctccagcacatgattttgcgactaaatcttgtacatgaggtaaattgggagaggaaatatgtttggaattttaaaaatgccttttaaaatatggttttactcagtaattactttagcagataatttaaagaaatttattgtgatgaatacaagacattaagatattttgctataaagttgttttagataggtatataattttagctggtttggctttgataaaaatagatatttgacctttttaattgaaacttagaatttacttatttataacacttggttattacccatgaaatattctgcaatacctcctggggatactataatgagtaaatgagaagttttcaacccagcagtctaggctggattcatgtgaatgtagctcacaggagcaaagtgacctattctggttctaagatctgtttctcatgtgctcagtgatgcctcttcattctgcctgtaacagaattctacagctgggattctgagaggctgtctcctggattcaagtgatttcctttcctcaactacgaacagagatgccccttctgagaaggaaagcaaacaggtttgccttggccaaagccccatggcccagagtcaagcccttaagtgctttttcaagtgcctagactagtttctttgaggaccagtcaaggtagcctaagaaggaaattacccaatcatttctgttctggcatccattagtacacatctgtttctttcagttctgtaggagaatggatctgaactggccacttccccggatatgagatgaggatacatctagtatgagatagaaaataatttccctatcctacaaagagttggagactgtattataaaaaatcatgcctaataacagtttatttgttaaatcttgctcatatatgctgtatagtatttctaatgacatttacacaagtagaaagcttgaaacttgggcatttgttctaggttttctcaatatgtggaccatgccctggtcctgtagaatctgagtctgttgaaggggcctaaccattgtcacttctttcagttattccagatgactccagagtaaactaacactcaatgtctatatggcctcatccttagatcatgccttgctgaactggctgttagcactcatttgagaataaaagaaacattagcaataaaatgttaaatgactggtgtgaattcaaatataaatgctcttagcttcagagacaaagtaactgtggagttcaggcatcattagtttctcaaattttagtgtcactctgataactctaacacacacaattttgcaccagattggcacagattttggtgtgataagtatgcaagagccaatgggcttttcttaggtatgtagtaacaatggaaatatttatctgcaagagtgaagaagaggccctgtctgaacaccacgtgggttacatttcttgattctttactttgtggtgagtatactgtaaggcttggacacatggcttcagtgttaatgttagtgtgcctggttttcccctttatcctttgtttccagcagcctcacactttgtctgacccctcagggtttaagtttctatgtctcagcaagtaacaacatcttaatcatattctgagtagcaccctccccccagttttatcactattcctagatactattcttaatgctttttcccacttaaaaaaattagaatagtattcctattttcttcaacaaaagccctgaatataagaacatttgatcattgcaaacagcgttttgcttacaaagttgtcttttctgccttttttttttgtttgtttgttttttgttttttgagacaggatttctctgtattgctttggaggttgtcctggaactcgttctgtaaaccaagctggcctcgaactcacagagatctgccgacctctacctcccaagtgctgggattaaaggtgttcactaccaacgcccggccttttctgccatttttcaaatacagtttggattgcacaccatgatgagtattgaagaatatctgttttctctttttttctttgtttttggaagattattttatccaaccagacagcctggacagtaatcacatacttgcttgctgacattttcttctctgattttgtcctctttctggtgttaattttgcaatttctgtatgttcaccttcactgttgaatggcatctcaggatctgcaatggtgatacacttttgagcataggcaatatatcgttgctaattctcagtgatgcttaggggttatagagtactgtatccctgatttcaagaccttgagaccaaagaggtgagaagctttgctcagggttatgctacaaggaagtggcaacattcacagttagagtttaaatttgcttgacttaaaaacttgtgatttcttagacttttaaaaattatattttaaaatggtttctcaatatatatgtacaatgttatggcttggtgctttttactttttgttttgttttcttgtttagtgtttgtgtttcaggtttttctttttaaaaattttagatcttcacaattctttaagaagtctactatggggtcagaggagaatgggagatggttcagtgattaacagcactggccactcctccaaaggacccaggttcaattcctagcacccacatggcagcttacaactgtctataacttcagttccagggtatctatcacatatatcagacaaacagataggcaaacccccaatgtacataaaaaataaatttaatgataagtctttatgccaaagctgcctgagttcagcctgtcatgttagggccccaaataatacagagacttatattaggtacaaatgctgcttggccaactgactaggatttcttacttgctagctcagtcttaaatattggatgctagctgctggcatcatctcttgccaggatcacatggcagctccagagtagagagcaggagaaagagaaaaaggaacgacttccttcttgcctgctatgtcacttcctgcctgtatcacaagacttccttttactacatttcccagaatcctccttgacttctagtcccacctatcttgctgcctcactggccaaacagtactttattcattaaccaataacataaatatacacagaaggacattccccatcaaataaatctttaaaaaaagaattctactatctgctctacgttgagggtactactcagtaagctcagtttcccctaacgatcttctactgtgatattaatcacattataatactttaatctacatactagatatggccattacaaggcagcaggaatctactttttttttcagttttaaattcttatttttttttttgctcctgaaaggggggggcattgaataaatgagttaagtgagtataacagtagccagtagaaattagtagcttgacccaaagctgtgaatccattgcagataaaagtatttagagaagggtggaaccctgggacatcattcaaatcaacccacatgactctgtacctagagtcccatttttcattttgcaagtgattatactaaagctgttacaattaattcaccttgctttgtccatttactaaaattgaggtcagagaatttcataattataaggctgtgccccttaaaaacagtttaataattgctcttctaacaagccagctcaataaatgagctacataagaaaagtgagcaaggatggaaggaagaagactccagtcccatacatggcacattagaccaacggtagagaagcggtgtctgtttcagaaactgttccaaattgggccacatgagaattctctagggaatctttgtttgagacacttaattgagtcagaaaacttcaggttctggtctcaggtctgctgttgactgtgtgtcagtaagaaagaagtttgcttgagcctcaatttgcccactattagagcaaaggtaagaaaatgtaattcatgggaagttcttgaagattttcataaaatcacataggaaaatagactcaggctgattctaaaagttgatgttaaaaagcatcagctaaaacaggtttcaagcaggagacactgaaagaagctctgtaaattatggctgtgataccaagagtacatttctccaaacaccaaaccagctggtatccccttatgttcactttggaatctcacctaggggggcttggctacacagtgcacccacttagcttgctctgccctgcttcttttgcttttaattgaaaaaggaaggataatttcaacttttgttgttaatttaataggtaatctatgactgcattataactacaggaaaagagattttaatacattttaatgagtcatcctataatatgacctcttagaaataaactctaatgaagaattttcaattcttcctagactattccctgtatttatactatattaatctatattatgatatactatatcttatttaatatgacatgaatattttccacaattacttaaatatagccataagtataggatggctatctcaattcgttatatgcaggtttcatgatattttccttcaagtcactaatgtcaaacatctaaatttctaccattttaacataaaatacaagtagtgaaaaacatatttatttgtatagtcattctttcttgaaggacaaatgataggggaagtatttctgtgtatgtttatcttattgattgtttaataaagttctgcttggccaatgaaacggcaagttaggcaggactaggagtgaaagaggattctgggaaatgtagtagaaaagtgatgatccaggcaggaagtgacatagcaaggagactcatatttaaagcaggataaacaggaagcatacctctttttcccctcctctcctgctccagcgacacaatgtgatccaccggcaaggagggacgccaataaggtgtccaataagataagtcttatagaatatatagatgtatgataattgagactgagctaacagatgagaatccttgaacaatggccaagcagcattgtacctaatacaagtttctgtgtattcatttgggccaaactcgggcaggtggctggtgaaaagctcacacatggcggtggggctcaggtggcttttggcagaaagatttattgtaacagacaaattcccacaggtactggaaaaaaataatatagacataaataatatatgtctatattatatacaaatattatttgtagaaagaagccttttgctattttacatattttatatcatcaaataaaagagatgcaaaataaatgtgttttccttttcatatctctgtttacactgtgtacaattttccaaaacatttttattgtaaaataagagctggagacaagacaaatacacataaaaatacatgtgcatctctgtatgcactgtttatgtaggcaattcttctttcattcggctttcaaggtgatcagttcagtgtagcaccactaggaaattacacatttaagcatgtttctgtgaaagttaaaatgatgcctctgatgtgtgaaaaatgtttgactttaaaattagtggtatttggcaatatattcataagtggtatttcaagatcatctagcctcatacttcaccgtttttaccttgaggtctgaaatcaggcagctctctgagaattactggattctttgaataagaaataggagctcagtgctacagcctgattaccacatcttatataatttgttttatcttttgtaaatgaaaacttgcattacaattttaatttattttaactttgcattttggacttagttttgtgtttggggagatattctcctctttgagttttacacacacacacacacacacacacacacacacacacacaatctatttatttatttggggtatttgtaattatttttaatataataatattaaattattgttgttagttttgcacatcattctattagagtttttaattatgattttagtaatacataggaaccattatttgtttaaatatgcaaattgaaattctgggtctacacatgtaatattaatagtgctaacatcgtggaagagggggcagaaatattctaagagccagggacagtagaggatagccaccaaatagtattttcagggtatgacagggacattgcacacatgaactcacagaagctgtgtctgtatgaacaagacctgcagaagatcaagccagcgaaaattacagtgtggcatggggagggtctcaggaaggctcatctctatctgtggaactatggcaattgatgactgctgaggagagataaattgttttgttttgttttttgtttcttctgataggctacccatgctctactggatgaccctatattcaggctgacagcactgagtggacttcagtgagtagaaaaagagtccatgaagttggcagtggaaagtatggggttggatatagaagagttggagaggagggagtggaggtggagctgatcaaaacacaatatacttacatgtggaaataacaataaattcaaataacaacagtgataatttcttttaacaatggaacatcttctactcatattaatttttaaggatttaaaggtttgagtgaatgaggggattggagagattgctcagaagttaagagtacataatattcttgcagaggtctgcagttcagtttccagcactggattgggtcgcttacaagcacctgtaactctagctctacaggatctgatgccctcctttgatgcctttgaggacacacacatataggtgcgcacacacacaaagacacacacacacacacacacacacacacacacacacacactgtcgtggcccagcatgtctcagcttaaacccatgacaaccatgaggttctacctgagtgggggtgtgtagacctgaaagctcctagcaaccaacagtcatcttgtcatcttcagagagctctcaggtctatgttgtagaactagagtcatttctttattagccatcttttctggtgtttcttaaccatcctgccatgaccacgagggaatcatctctctctttgttccctctctcctccggtcactcgacgcccctaactcctaaccttctgtcctcacaagttactcacacacctctagcacctctgtccaggtgagggcctattcagaagcttaggcacatacagatgcaaattaggagacatattaccctgagtccatggtaaacaatagtagccctactggcattaacaatataatagtgggccggagctttctggtgttcctgcttagtgaaaccaaaggctggatctcaaaatattccatagcggaaagattttggtcccccacaacacaccacatacatactacgccacagcacacacacacacatatacacataccacacacacaccacatacactcatacacacaccatacacatatacataccacacacactacatatacacaccacatacacacaccatatacacaccacaccacacacacacacacaacacacacatcacgcatacaccatacacacacaccacacacacacaccatacaccaccacaccataaccacacaacatacacagcacacaccacacacaacacccacacaccatatcatatacgcaccatacacacaccataccacacacacagtacacacagcacacacatacagcacacatacaccacactatacacataccacaccacacaaacacacacgtacaccacagacacaccatactacacacatacagcatatacgcacacacatacacacacatatacacacaccacattgcacacacacacatacaccataccacacaaacacaaacacacacacacaaacacacattaaaaagtggtcatttcaagaatgaattaatctttttttgtttttcatttattgttgcagaatttggtaggccttcttgataacatttaattaatatctgtacaaaataacaagcagtgaaattttggagacagcatgtcttcttaactaaaaataagaaggaaatggtgctctttcagttggtagtctctgcttctgcctaggaagcacatacaacagctttaagaagcctcacccctcagactttggagtccacagtagaaaaggaactgcccatggtcgccaaatagggattccttttccaaatgaagttccctaattagaaatctcccattgctaagggatgctaaggtcagcattagcagccttggtcttccaactgatcatagacaaatctgctagtggatatttcccaagaaatggagtgtttgcagattgcttggcatagattcctataaaggagaaagctcccgccccatccctttatgcttcgtttcctgcctgccaggctccaaggagacaaatgtttagatacagttgaaacatcaacagcagtttataccagtcttagtacaatacattatggagaacagacaatgttgcagtattgctcatttccctccagttagcaagatctttaacttcatccttgaaaacagaggactgccctatttccagacccatcttggtttttccttttccttttcacactttgaactgagctagtacccacgctgctgcaggtctggccaatcagaagctcactgtatttggattttcagttttctacttccattgggttcctctgtcttttacaaatgtaaaatattctaatcaagtataaacagatggaaaaaacaagactcattctgctcagtcaggggattgggttgctgatgtcattcctgtagtggtggccaagcagttctaaggagaataatcaatctagcagaccctgcttttcagttagaaacgaaaacatttgttgtaagctctcttatctcctccttttgttttctcctttgcccataggaagggaagaaatagaggcgaagagaaatctctgaaacagttgtatgctttctttgtgtgtcacaccacaggcatttctttccatcctcctgtctcatgccactggttaatacgaattttgcttgcaagactgttattctttatggacagataaagaatgacacagatttgtatttaacagtcccaaagctcttctcacaccagccttcctcttaattcaggcattgctgtcctgtttcacggctttgtctaggccctgtactctttatcttcacttaagcctgttaaaagtatccgacggagatccagcttccagccagcagcatgcctcagatgtcttataaatttgaatgcaaaatatgtgaagttgaattggggattcatagcagacacctgagcctcatgtcttactatttttatatgccactgtcataaaaagcttcatcagccaccaagcatcaaaactgagtttctaaggtgatttttgacttccctttcttggcgattctttctagtcaattagtagtcaaacaccattgctttgttctagattaaagggccagcatcccagaaagtcacatgctcttgttggttttgtggtgctaagggcagaatccagggccttgtggatgccaggcaagtgctttcctactgaggtgtcaccctggccccagccttgttttaatttaaaaccagaaaactcgagtttaatccctggattccacttcctgcctggagtgagtgagatctgctgctttaaatttccccgggtctcttgtgaaatggaggtaaacataatatagatctcaaaagaattgtggatttagaatagcatgttggaagacttctatagatgttaactgctgtctgttttttttttttttaaccattattgtcttcagtcacatggcccttgactttatttctgcctatgatattgagttgtttagtccgacttctgtctgcatctctgctcattccatttcaaatcctcagcagagtttctgccagttaaagacccaatcagagctgaataaagccacattaggcatttcaatatacaaaatcaaagatggaatgaccgtcatttattagaacacagaaaataacccagagaaggaaccagatgaacaacttatctctagagcagaagcaataaggcaggaggctgtggtgctcactaactgaagtaatcctataaagcaggagtcaaacttatgtgatatggctgggatgcccctggtacctccccaggaacagaagaagcctgggataggagggccaggtgaagttccaaaggtaaagttgtgttgacaaaatttgtaacaaatggaaaagaaggagctgtttttcaactccttattgttgcagttttcagattccagatttcagagaaccaactggtacaaaaatgtgatttgcagcacacctggtcataaagaagatgaactggatgaaacataagcagcacagcatcatctaaaacacagaacctctctgttgcctgaaaaatcaactgcctattcactgcttagatgataaagttcagatgcctcaaactttggacaaaaatctacttttccagttctttctcctaatcctttatttcctcaccattatccctaactgggagttccttgactttgcatgttttgattcattctcctgaaacgtttacttcctctagagttttactccatcgcctttttgttttctttattttttttttatttttttggttttcgaaacagggtttctctgtattgctttggaggctgccctggagctcctcttatagacaagtctgttctcgaactcacagagagctacttgcctctgcctcctgagtgctgggattaaaggcatgtgccaccaatgccctgccatatgaatgaaatcctcgttattcaagattcatctctactattctgttgaaattccaaggcaaaattaataacctgctgtggtagttacctttaaatttctcagacaacactctgtgaccaaagcagtttataaaaggaagtgtttaactgggggctcacagttccagagggatagaactcatgaccatcatggtgggaagcaagacagcaggcaagcatggtgctggaccagtagctgaaagcttatatcttgagataaagccatgaagcagaggagagagagagagagagagagagagagagagagagagagagagagagagagagaaccaactgggaataaatggatggcacgggctttagaaacttcacagcctgttcccagtgacacgcaataagaccacacctcctaaatccttcctcagacaatttcactaacagggacaaactattcaaatatgtgaagccatgggggggttcatcctcattcaaacaaccacatctgttcctctgtaagtctacaaccatttttttactcattcaaataaagtatgtatcggtctcttattatgtaagaaatgtgtgcaaagtactgcacatacaacaatgagcacagcattcttggtcgctgttaagttgaccaccctatgggacagaccctggaactggaatctgaggtaactagtggtaattagaaaggggaagatggattggagagtagcaataaatttggtcttagacaagttaaccttgctgtatttttttaagatatctaagaagagaacccagaaagctgtggtgcaaatgagtttagaagtctaaagtaatgagtgggtagagagatgtatttggaatctggatttacatttacattctaactgaagtgctggagagagagagagagagagagagagagagagagagagagagcatctatatgtgtttcttgtgtttgctgtctgcttctgttggtctatatggctctctctgtctctcactctgtgtgtctatttgtctatcttgattctttccccctttctgtctgtctctctatgtgtattgttgtcacatgacatagagtgcacttgtacatagaaaagcttgcagtaactgattttctctttcctgggttttgagcttacatcatcaggtgagactgctaatgcacttactctcagacattataagacaaaatgattttaatctacactggtgtttaacagtattgcatgttcttatttaagaactgctcacaaggaagttagctacactaacaaaaatataggcaatagataatcccacattatcaaaagccaaaaagggaaacacacacacacacacacacacacacacacacacacacacacacacacacacacacaccacccacaccaaaaccaaaatccaaaactagcaagaatcaactgttcattaatatcccttaatatcaatggccttaatttgcctataaaaagacacaggctaacagaatggatatgaagacagaatccatccttctgctgcatacaagaaacacatctcaacttcaaagacagacgttaccttggggtaaatatgtaagtgaccccaaaaattctactagggaacttgtacaactgataaacaccttaagtggcaggatacaagattatctcaaaaaagttagtagccctcctatatatatgtacaatcaatatagggaaagtggaactcttacccaaaacaatctacagattcagtgcaatcccccatcaaaatcccagtacaattcttcacagaccttgaaagaacaatactcaactttatatgaaaaaactaaagactcaggatagcccaaacaaccctgtacaacaaagaaactgctggaggcatcaccatccctgacttcaagctctactatatagctatattaatgaaaacagcttggtaatggcacaaaaacagacaggtagaccaatggtattgaattgaaaaccccgatattaatccacacacctatgaacacctgatttttgatgaagaagctaaaattatacaatggaaaacagaaaacatcttcaacaaatggtgctaacagctgcaagaccatgtctgcttgagctaatataaacgttgcaaagcacagatcacagtggctggtgtgtaataaacacaaaatcattgctctttcattaattcagatatttagcttttaaaaatgcattttcttggttaacaaagcagagatcagtaaagtcttcctatccctgtggaaaggaatttgctgcactgtgaaagtgatcggacagaggcaattaaaatccttgagtggaagaaagggagagtaagtaagacaacaatgccaccattctctttccacttcaaacatatgaacaacagcagaacacagaattccgaagaaggatgtctagttgttttagcttcgtattctatgatctaaaatgttgagctacaccagtggaatcctggaggcagagtcacagataaatctcagatatcctatccctttgcatactagcattctatgcccacagcacatataatccatccaatgtactacagacacattaaaaataatctaaagattaaaactggaaaacaaaatgagtttatggagagatattttggtgtgccaaattaaatttgaaaatgcgattgattaaacaatttgaaaataattctggcaatgcaactaatactgaaacacaagtaggcctaacactgaattagtcaaggagttagacacacaaactcattgagaattagttgctgcaaccagtcctcagcccaaggcaagtctgagaagtctgagaccaggagtagcaaggcactcaatgtgttcctattcatataacaaacaccttacctagagcctggcttggagaataaagcactgctgctcttccttttcacatgttaaagacctgaattcctccaagaagcatcatatttgactaagttattggaactctgttctttattttcagtccccgaactgtattctaacttttgcagcatggcatttctgagtcaaataggagacattccacttttattgaacttcctcctcacttgttacccatcaatcatgttttagactgcagggtcaccagcttttctctctgtgacattgaaaatgtggaatgtttaaagcaagaaaacaactacatccttgtaacaaagatcgggccataaagcaaattataatgggcaaaatcattagctgtttaatactgattgcttattctacataacttataaaaagtgacaaatggtgctttgttctctcaacttgctgatacactgcaagttggatattcctttatgtctagttcagcagtttcagaaacactgaaacattctgcatacagctgtgttcccacttgcacagacgaaacatctgccaaagcaaatactggtctctccctgtaattctaccactccaccagaatttctcctgtatttataggatgggcgtgctgattataagctggagttctggtgtttggttctcaactacattgtacttaagttcgttctatgtgtttttggttagaacttgaaagcaatgccacttttagatttgggagggtgcaaagaaatacagccagacaattacattatgttcatggtatatcctcattatgtgtctttggaccacatatatgtttgaagtgctcagtatttctctcctttccaaaatataaatttaaaaactctatcacagatttatattttgtatgcaacagtgtatagtacaaaaaatgaatcttgttcttaccattttaatgtatttgtgccatagaaaaacatacattgatgaaaaagggtttaaaagacatcagtcatgatactactccgggaaattggcttattaagtttaactccttttaagaatgaagagttgctctgaatatttttcagtttaacagggagtgaaatgttaatgatggaaacttgggtgagagcagagtaccagattgattttgtgcatctgatctatacttgtccatacatccacacagtttgctcaattgataattatatcagggatgaccattatttccaataattgcattttatacttttctacagctctcaaaatgataacatgtatctattttagtttttacacccctactcatttttttaatgtagtaggaactttcttcaatatttacacacacattaaagagtcagatcaggaatatatcagtggaactagatatattctttgcagtggcacactgcattcaacagtggttatgaaataaggctttttaaattttacttttaattacatcatttctcccttcattttttcccttcaaaccctgtatataaaatatcttgatttttttcaaactcaagtcctctttttaaattaattgttgttacatatgtatatgtacatgtatacatacacaaactccgaaatacataaagtgccacctgctcattccatgttgcttgtatgatgtttgcagggatgaccatttggtattagataaccaattaggatgattttccctgggaagattatttctcccactgtcttgcatgtaggttttttttgtgtgtggttgaggctttctggtctttcccattcactttggcatgtctattgttgttggccttgttcagctcatgtttagcagtcacactgatgagattttaatgggtgtagcttcttgtcttagttagggttcctattgctgtgaagagacaccatgaccatagcaactcttataaaggaaaacatttaattgggatgggttacatttccagaagtttaatatattatcatcatggtgctatatggtggcatgcaggcagacatggtgctggagaaagaactgagattcctacatcttgactcacaggcaacaagaagttgtctgaaacactgggcatggattgagtatataccagagctaaaagcctacctccacagtgacttcctccaacaaggccatacatactacaataaagccatatctcctaatagtgccactcccaatgggcttatggggggcaattacattcaaactaccacatatctgatactgggaagaaacacattctaacaccaaactcctcactcctctggctcttacagtatttctgttccctcttccataatgatccttagccttaatacaggtatcctattatatagatgtatccattgggactttgctccacaactctgcattctgatttgttgtgattttctgcatctgttttgaatagaagtttccttgaagagggatgaaaatgacacttatctatgggtataagtcaaatatgttggtttagtaaagtggtggctgctgattctcgttcaagagctaagtttccagcaccaggcatggcttccctccttttgaggtaatcttaagtctaattagagaactctttgttaccaccaaagtaggcatgttactactacacccttaggactatcattctgtatggatcattgctatggctcacaggcaccatatttatgtaggattatcggttgttttcctcatttggaagttgacatggtgtttgcatgcaaaaatgtatacaaagcttcttgtaccacaggagcaggttttagggtttcagctcagggtcctctgaacccttgtgtgaagtacataatatctttagcaaatagggactcacattccacctctggtgggcaaccaagggcaatagcaatggcctgtaatgttttgtgagtctcttggacaaccacagaccaacaactcaaaagaggatttctcatacctagttttgggaattttgttttgtggcctttgactcttggagggagcattgccagcccagatgggaaaattgcctttgaaagatatatacactgacttatgtgtattatgaaaatggaattcattgtaaacatctaaaacacttactattaaaacaaacagctcttgatgactgatttctcagacatatcattaagggaggtttctgataaacggctttattcaatacatggcttccatttgtgaacaagtaatcctctcttgattgtcccttgtccttctatcaaaatttcttccctacattcaaggaaagatcactggatttcttcaaaaagtggtttcttttgctttgtgattccttggtgctatttgtactctatcaaggtaaagatgaacataaattcatttagcataccattttctaactcccacacagtatgtagaagtttctctaggtcctgtcttctagtacccagacagttaactcaatttctccagaaactgtttccacctcctattatattattgtaaactgagagttaattaaagaatttgacaagaatgtttgaattagtgttggattatcagtagccactgaaagaaatgtacatttgcaaattaaatactaatattaaaataataactagaaaggggtaggatataaagcaagataatatatgtcatttagccatgcaaacattccccttccctgaagtccttgacatcttactaatttagattgtcaattcttcacattatgagatggaaaaatccttggaaagggattggtgttataaatattagacaattactatacagggattggtgttataaatattagacaattactatacaggggttgctaatgaaatgactttctttaatattctgtgtttttccttctatgagtggaataaaaattgtaagatacttttaaaaatttgaaaaataaatactgtagtaaaaataaagttaagagatgaatattcttggatcatgaaatagatcagtatttgtcaagcagtatcaaacttttggagttcttcaaaatgttgtaattattaaggatcctaaataaatttgggggatcatatcaattgatactaactatggtctcactctgagttttaagttattaattaatttaaaataataataacataacaattacatattgatataaatgacattgttttatgaaactaaaatttaattagaagagaaatattacatttttaaagaaatcagtttaatatttcatttaatagaatacagcagaatttttatatttacatctgatttcgatctattgccatatgtcgttatggttaaagtatctgaaaaattctggcttcatacagacacacagttaaaaaagagaaaaatctctcccatgaaatctctcccttcatggctcaggggatcctagggaagaggaggtaaaaggagtgttagagtcagaggaaatggaggacactaggagaacagggtcctctaaatcaacaaatcaatggacatatgaacttcagagaatgagggagtgtgggtaggacctacacaggtctgcaccacaaggggccctagatctgaaaggagacatggacacatggtcctacccttaacccagaagcaatctccaactgattgccacttgtaaatgaaaacttagttttctctaagaaatgttactgggaaaacaaattacacctaaggttagacaacagcatctttggaggttccttgtctcataatgtcttgtcaagggtttttcttctttttaaaaagtttattcttaaaaatactttatatatgttataattttacacacacacacacacacacacacacacacacacacacacacacacgctaccctagaggtcttctgttgagtgtttttatgggatttctgaatgtgcaaattagtgggtctattgtgccttctcttgggctctttttcttatgtttattttatcttatttcaatgttagcatttgttttctcttatagtttattgtgttactatcctttagatgcatctccttctaatgagagacagaaagggagtagatctggatcagggggagaggaggaagacctgagaggattagatggagggaaaactgtaatcagaatatattatgtgaaaagagctattttcagtaaaagtaaataaaataaaaaaaggaaaaatttcacagacttatactgtttcctttcctcatagaaaatttgggagttcccaagtgtatttattctgtctgggatttagaggaagaaacagatgtcaggtctgggattaagttctacatgactcactcatatatttttgcatgtgatttaatatctcttaatcaaatgttaattatctgtaaaatgtgtctctacctcattgtgtggttgagaaaaatcaatgagatattgttgtaaaaatcgtctttgacatcaaaacagaggggatgtaacaggcatttttaaactacaaattcagaaagttctcttaataggaatgatatttcggatacttatggtcataaatggtaaaatatcaagagtttgattctatatatggtatttaagaaactgtaaagtttgttttatgtagcctctgtcactttctctcaatcaatgtttttaagtcaatgctcaaacgaagtcagggagtttggagtaaactggcaaatcaaccagcattgcatcacttactaccatcctcattttacctaggataaagtacattgtttggttaaaaataacttcagaatctttattcttaagcaataattgaacaggatccttcttgaactctttgtgttacatattggtaaataataataatatgtgatttaatttttgcaatttacaaagtttgttcatgaatgtttcttgtgggactcttggaagaacaagctgcttttaaccatccggttttgcaaagaaggcagtgggctctagggaactctgagggcttcctatgtaaagtggccagacctcacatttcccatggcccttatgccagtgttaatattctgaacaaaggtccttttggagatttcttaacaaaatgtggattttcactccatttgttttcatataaaattaaaatttggttatactcaactctttaatgtttcacattaaaactgtatttgaagtagaaacttccagataaaattagaaggggcccacataggagtgtttcacttctctctgatacattgacttaagctgctgaaaaagatattagagagagcctgggagatgggatgatgtcactatgtgaaaaacagaattctgatctacatacggttgcttattcaagcatagtttttcttgagccatgtcttgttttggaaggaatgctgtgggtgtggttctgcaacaaaaccaagcagagttgtaaaaatgttatttttttttctacaagaataaagatgtggggatattattcaagtatttttctgtctccccaatggcctactatagagattccagttcatcaggctgactaatgaaataattttagaagttccaaaacacaatgattgttgtagaagttctcttggcatactgagtagaccattatgagataaagctgatgtcaaggctggtgttacagcagttgaatctctgagatatttctggtaattcttctcatcatatggactcttaaattgtaagagttttgggtgggattttggtttgtccatttggatgagagaccagtgacttaactctgcttggctagtaataattttttgtcccacctgaattttctttaatcaccattcaaccagtatttgctggtttagtagactttcaaaagttcagtctaaattccacaaaaatgagtatcccttccaagactttcccttacccttcctgtgttttgtgtacttccataggactcatccctgtactacttatgatttaaatgtcagtgtttgatcttaccacctcatccagtatagggactagactctgccctgtacatatttatttccctaaggtgttctcttagcaattgtgcattatattgaatgccacacaactttgaaattggaatctacttcatccttaaattgggtaaggacattaaggtaaacaaggcacatttgagacaagtgtgtggtccctaatgctcatgtctcaggagtaacagtagcatcttagttctccttgctacttgtaatttttatgttccccataactggaatatttcaggagatttcaaaaaactcttaaaaatttagtagtgctcagaatttgtgtaggaaatgagatatgttatagcttcaggaattgacaggctttggggattgactacagaacatgaattcataaaattatctttttgcagacaaatggatgtaggttgaattacagtagactaacaagaaatggccaggtattctatgaaccattccattgtctatgctttgtgttttatatacagaatgagatttcagacattctagcaacacttttcaagattccttttgttcctgattgagggaggcagtcacaccactgcaagggaagccagaggacatttataaaatcccactcatccaacagtaccttatgattgcatccatccagagctgacaagtcactgtaaagtagcgcagtagacacatatgctctttcaaacctcatgagagcatgccactcacccccacaaattaaaacagtacttttcctactggtgagtgaaacctgagttagaattcctatgagctaggaatagtacatgtcttttcataggaagtgttcacattggggtttgacttttagttttagctgccacagaggattcaggcttatgaggacacaataattgacaatatacttcaaatcaagttcacaaactgccttttagcaactcttaaagaaaaggagtatttatttagtatatgcatatatactgtattaattaaatagcaattatgtcagatatgcagaatgcttctgatgtcaaaatggtataatcattgagtaggcagccttgtggtgtttaaaatattggaaaaatctagctatatggtaactatgtttcaatttataagtcaaaatttaaccatgatggttgaaatttactttaatatccatttgtgaattcagggattctgaagacatttaaatagaaactgtagtgtaattatgtagtgtattttaagtcactaatttggacatatatttttattgattatttaagcctgtgggcaggtaatgtgtcataggggttcagagcagaccttcctactgttttgtacactcaagactgagccctgcagtttatttcccatgtgacatgctccaccttggagagggagaacagatggtatttttttattacttaaaaattgtctaaaaatatttttcaaaagttaggcatttcacacttctgacagtgataaatgggataattacttttattcaaatactaacaaaattataacctataaagcagaacacagcagaagtggcttcaagcaagttcatgcatctgtttgtcttttctaatagctaggttatagtagcttcctgcaccccctgcaaaagcagagaacccccaaacttcaaaacaagtgactacagagcacaggaaatagctccccaaacccaggaaatattcaaattaaccaataccaatagacttataaagcaggataaaataaaatggcttcctcactctccactgccctctctatatcaagaaaagactcattcccagaccccgggccaccacataatggttaactgaacaatgaatgtaaggcttcgatgggctgaatggtgacttccagaaaaaccatcttgaaacttctagtacttgaacttccttaaagcagacatgcagggtggcatgctcatttggtagaaatggcttttggtgtcagtgagctcctagacaatttctcctttgtagcctgtatgtagccctgccatttaaaaagtttcccccggggaagccctgactcattcatgactcttattttagctacacagaattgtctattccagtacaaacaatcatccatgcctcaaacttattagacttaaaagtaaataatggattagtggtttaaaaatgaataaaactttaaaatatgaatacaaaaagttaaaaacaagctattgataggtcaacatgggtgagtctgagaaccagacacagaagactaagaatagaatgaatctatttatctaacaacttagaacagcaaagccatagaaaaagaaatcaggtaaggctgccatggcttagatgacaggaaacattgactccaaattgaggattttggggaggcaaaaataatgccctaggtattgtgattatgattatgatcttacacatttgtcagaatctgaagaactatacacctcaaaatatgatgtctgttttgtagaaataatctctaataaacacatttctaaagagggtagcaagtggaacatatattgtgattaaattggctagtcactgtgttttttatttttaagtaaattttattttaagtaaaagtctgacggcaaactttttattatatcagcactaatattactatgttatgcaaataacttctaaattctttacaactctaactcattgcattctcataacaaccctgtgaggtagtaacctgggggtactattcccattttgcagatgaagagattgaatcaaggagaagacatgggttttcttaggaccacccatctggtaaatggttggactatcatttgagttgtctgtttggctttagggccacatttataactgctgcatttccatgaaatgtttaaagctatttcctaattagtaaaatatgggtaacttttaaattatcaacgacaatgcaaggaatgctaagacttaggaaagttatacttgagaatgattctttgccttagaagaattctggaaagaaattaattaatgttgttgacatttcctagggatataataagcaaacatctgttcttcccagtcagtgttactgtagcagaccaaagaaaactccacccatttaacttagtgaaccaataaatttactgaaggcacataagaacctgtggtgactcaaaggctgctacatcattggaaaactcaccagcatgggtgatgactcacaaagctaatatgcaggaagtgaagctccttggagatcccctctccccaatagtccttactgcatgtataactttgggtagggaccttgtggatcttgtaagtttcaggcacttcctatgtttgtgagttttgcctgcttcaggaattatcatttcccatcactaccaaggcctctctgtccatgaaggattgttttaattcagagaaaatagctacatatcacttaattgctctgaatccaaatcacgtgaatatataaagacatttcaatatgggcatgtagacagaagtaacatattttgaagtttggatatcgataacacttaaaataaatcaattaacacatgtgtttatttacttgaaaagatcccgtagcacctgtgataaagtaaagatgcatactgttaagctatacattttcagtttgatcctcaagatttgtactgtgggagagaactgacttttacaagcttcttcttgatgaaaatgggataataggaaattcaagagattatagaaaacgaagcagcagtttttaatatgcatgaggtgccttacatggtatttaataataccaaccatattattactgtgctttagtggcttccaaagggactatgttaataaaataatgcattttttttctgttcaaattcccatgttgcttttttaacgagtttatatgtataggtgaacctaatgaatgatgtgctctatttctgctattttacctattccttgtatagtatagttatttctattattttcctagtcatctagagtagacatcttgcaagcatctttatttatgctcactaacacttctgtctttgttataaaccacctttttgattttttactaaatagtatgtgttcaacaaataactacttggaacaaatacccaacaaatacccatcaaggagccttcattgtggtagaagataccgataaatacagtgtggtatctctttaaacatgtcagtctgtatcacaaaatagaagtgtggctggccaaggaggcaatggctaagttttgctggcttcattatctacataggtggcagaagtgttgtcccttatagaatccatgtttctgccgtttttagtggatgaacagtctttttttggccaggggggaggcttcgagacagggtttctctgtggctttgaaggctatcctggattagctcttgtagtccaggctagtctaaaactcacagagactaactggaggaagaagggtattgggattaagtccttggacataatttacatagacatatacataaacatacatacatacatacatacatacatacatacatacatacacacacacacacgcgcgcgcacgcgcacgcatacacacacagaaggggagagagttattagagtggcttacacttacaggctgtggtctgggtagtaccacactagctgtcttatggtacaaagtttttgtttagtccaagactcgttgctggatgtctcagcagtcccattctaggcctagaattccgaattccagagaattcctggagagctgctagtcttcagtctatgttggaatcccaaataacttgtttctaataccagcaaagagatgaagttgccagtggcagtgagggccacaggaagaaagcaaaaacctccttccatatccctttatgtgagttgccaccagcatgtggagctgatgtttgagtctccccacctttatcctcacaggcatgcccaagatgattgggtttgactctggatgctgtcaagttgacattgaagattacccatcagataaacaaaggagagaaagggcgaactgtcccaagataagttgaagggatgagaagaatggagagggagagataaactcagaaagagtgctaaagatgtatttttttcttgagataggaacatggtgtcaggtaggtctagaagagccaagaagcaatggtaaccctcatgtgacgttaaccatcacataagtaggaactttgatggactaacggcagacttgatcaagtaagcttctttaaagcatagctttttttttatagagagtttgaaaactaatagtaaagtaaggctttagaattgttatgagaactgctagagattcacttaagtatttgcagtggtgggttgctggcatgcctcatgagaactgggccttaattctgacagccctgctccaacaataatgactagagctcatcctctacttctcaaaaggctaagaaatagtggcgtttaattccccaggaattcaattcaactacatctgttaaactggtatatttgctgacacctgtgtacattctagaattttctgcattgttgaggaagaaaagctctagctgaaaactgttcactatttatggcttcatggcaacagatggcagaagctcatggagaactacggtgcagacactgatttgtctcagctctcaggaaaatgcctcctatgcatggtcttatcacagacttctagtgtgatgcaaagagatggtagaaattatggaggtctgagagatggtttcattgtgtttctaatttctcctatggaagttgtgctcacaggtaaacttaaaatacttatattgtcaagcttataataactgttgtaacagcaaatggaaactgataggagcagatactgaggattagatttgctcacttggctccggcaatcttaccttatcatgtttgaactttcagcctggaaatagtttccaagagctgtagatcctctacaaacatcttttatctcagtatttcagtgaagattgcaaatacccaaaaagttggcccaggatactttttggtgccaggataatgttgttatctaaaatggtctcatagtagaagaaaactagtaatctcagtgaaaactatatttttcctgtatttatttactttttgttactgcctttgattatttaagaagataccctttttattttgctttttgagattataattacaccatttctctcttccctttcctctttccaggccctctcatacactcttcctttttcaaattcatggcctattttttcattaattgtagttaggtgcataaatgtaaacacacacaaacttatctatttctaaatgcataactgcaccctgcatcttctgtatcatgttacttgcttgcatattttcagggatgaccatttggtattggataaccagttggtatgctcttcactgaggaaggctatttctctcatgcttagcattccttagttgcctgtagtcatctgtgtcaggttgaggactcctggtctttcctctgtctactttggcatgcttattggtattgtccttggtcaactcatggttaggcagtcatggtggtgagactttatggttgtagcttctgatattattagtagcagacaccgtttcatagcaaacttgctgatcctttgactctttgtatttcctcttcctcaatgttccctgagccttaggttcaggagttgttttgtagatggatccattaaaatttggccactcaactctgcattttaattggttgtggttttctgaagtgatatccatctgctacaaaagggaattccttgatgagggattaacaagcgtattgacatcatggattttctcagatattattcaaagaattagaagaaggttgatttttgctcttcatttagcctattaagtgggagcaagacagcaatgggaacagcagtattggtgagggagtcactatatagggctaggaagccattctttgaacttttccagagtctacctgtacctctcaaactgaagcctctgggatttcttttactaagaaaattaaatagtaaatcaagcctatattcctattctaattatagactttttttattttggaggtttaattcattccacacagttatatatctggtttgtaatttttttttgttttatgtagttttcatcagttacatatgcttcttaaagatgacagatgtggcctttatttttagtatgccattgtcttaattagggtttctattgctgtgaagagacactgtgaccatggcagttcttataaagaaaaacatttaattgggtggtttaaagttcagagatttagtctgttatcatcatggtgggacgtggcagtgtgcagacagacatggtgctggagaagaagttgagaattgtacatctttgagtcataggcaacaggaagtgaactgaaacactgattgtggcttgagcatataagagacctcaaagcccacctccacagtgacacacttcctttaacaaagccataactactccaacaaagccacacctccaaatagtgacactccctatgaacttaaaggagacaattacattcaaactcccaaagcccctcccttcagtgttcagtgaggctcaaggtacctaatcagtaccaaataattatttacagttgagtcacatattgtgtggacagactgctgatccttgaggactcaaggtatcaaatatattagactgctttaaatgcaaggtcttgtcaagcctgagtagggcataaagttaatggctttggctcataacaggaacgttcagctgggactaccgtgcttcctggaaagccatttagggttaataacagtaccatccacttttatgtaggtagcgctttgcaatttggaatgtagttaatggcacattactcattttagtgtcgccaaaccatgcacactggtcagggaaaagccctttttccaacaagaaaattggagtgcacagagataaggactatgtagaacttcacaaaattggtgagtggcagatctgatgctggaacccaccctttcttcgtccaaaagcagtgtgttttcctcagtctacacaactcttagcagatttttctttgttttaacatagtaaaatgctctgtgacaaggaaaatgtatagatattactctttaagagatgtagaaatagcttagtgaaaagcatctcaagtttgttttgcagttttatctagtttcttctctaagaatcctctcagagcatgagaaaggaaacagaatgaggattggaacaagaagtcttcatcggcagtcaaaagaaagggttaaaaattatgactttttaaaggcttaaagtggcgaagatagttcagaatacctaaacgcaaaaaagaaagaaagaaagaaaagaaagaaagaaaaagaagaaagaaaaaaaattcactgaaagggtgtccatcctccctgaaccttttttagtacctctggaaaagtcagggggtgtgtgtctgggggaagggtagggaggggagggttagacttcttctattaggctttctttaaaaaaaaaagaaagaaagaaaagaaaagaaaaaccacacacacactcaacagaaagaaataaaagtttgtctctctttggctccatctgcgcttaaagtctacaagaagtagtgaaaacccaagtcgcagaagcgcgcgctctgatttggttgtttaccatcaatcagacggttgcttggcagacactggatggttatgagcctgaacaagctgaaaggggcaggaaaagaagtggaggcagcattcttcctatttaaagctgcatcgcttgaaaaaagttttcgcagactgtgccggagctggtgctgaaacaggctgaggcggcctgggggctggtgctgaaaaagagccctcagcggaattcatggtgctacagtgacctcagtatctactcttcgttcccaggacccacatgtctcagatttagacatgatggcaaactgggtggtagcaagacctctcctcattctcactgttttattagggcactgtgtctcaataaaagcccaggaacaagagaatggtgagtttgccttttgctttgctttatggtgtttatggcttggtttgggactagatggaatgttaagctgcaggaagagtgtgaagaggagactatttaaagtttgagaagggggctgtgggacttgggacttgtacctgggaaacagcttgactccggagcttctgtgcttgtcctggcagagtgagctctgccgtccaggaagagccagggtagatcagttttgtttttttgtttttgtttttttttcgcctgaatgtaagaataggacgtttaaaagaaaacaagagtgcttaaaacggagccccgaaggcacttttaatcggagtcagttgtgtgggctggcgctttccgagcagggaaagccgctgcagaagctgggcagggtggagtcgttcctgcgcgaacttcagctgcttcatgaaagtctttgtttagagaaatctctgcggcaactctgatagctcggaatttcctttgtctttgctcttcattcctctttccccacagcctcatcttccccgcccaacgttttcatctgtgatcttaaaatcgtgtttgcttactgagagagagtcaagtttatttctccatgacagaggctgatggaagccagatttcttaaactgcggcattttctaaccctactgacttggttatccggacagtgtggttcctgggcgggggtggggtggggtggtggtggtggctgaaggcaggaaatcagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaagcaaacaacaagagcaaggaaaactggcttcaaattcatttaaaaaaagtttaatccttaatttttgagggttgaaatgccaactacagacatgttctcatttgcaataggctggcatagatctgagtcatcactagtactgcactgaagcttttaacttagcacatgtgttaatcatgtctgttactgtctttctcatgtatgtagcaacccatctctatacatttgcttccttcctccctgtctttttcctctaaaaatgtttagaaactaagtttagcagttagccatgtgatctagaaaactataaggagggaaaagaagattctggagatgaatttcaagtctgtcatagtcccatagagggggccctttctaaaatcttggaacttttaagtcagtttctatgtttcaaagagtgagggaatttagaaagggtgaaacttatcatgtttcttcataatgccatggaaactatgtgttgcttgtaaatgcaaggacagaggagttaggaaagagaacaaacaaagcattaagggtagcagtaaaaatgtctattaccaggggtctgctcactcccttcccccaccaggggccaatgttaaaatgtctgtgcagacttcattcccaacttaaatttaaattatgtgcttaaatttgcaaagtatggtaacacttgaatatgtgtgttagtgaaagatataagatgtttgaaagtcttagagggtaggccatatgctaaaaaacacttctaagtcattccatgtattctgtaggtgttactgaaaaccgaggggtttacctttctctactattcatttacataaattaagaatatgagattggttcaaaagcagttctgcctctgaaccaacctcttttataccagtgttgtcaaatagcaaagaaactcaaaccccaaactgcagatttttacggagaaagtaaattctttcattgacattgattgtaattcaaaataaatgtgataaaattaattgcagaaaagtgtgtgtctaagtaaggataatatttgcgactcaataatctagtgtattcaaagccattcaaacttacactggactcacttttcatgcatacttggatgtgcactgatgctgtgtggacacttgttatacttcatttctcctgttagaatctagtaattccatgttattttttttaatttgggaaacagtacatgtggaatgtttttatattacagaaaagcctaaggcttgcatgtcaagaccatacaattttcaaattgttattataagtagcatggatagtggtatttcctttgggttcccttgaatacgtgttataaaaagctggcattgtatggacgtatatatatttaaaagcttaacctgttcttttgttagtataaagtatagctgtttctttttatttctttcttttttcccccctgtggaccatgaaacacaaacacagtcctagcctaattggaacacatatggaagctaagatatagtaaataaagttttagacatttctggccaaaatagaactacctctcactcaactttaaaagattgattggattttaaaagttttttagaaactaaaaagaaagagtttgggggttggactaactttagtagaaaagtataatgtagccaagatgataaaatcagcttttcaggatctcccccacccccaaacactccttctggtgtgtatgatgtaggggggctttggaatgttccacatttgttttttgtaagagaaaaatactaggtcattttatttccaaatcaaaatgtaacatctagggaaagatgcacatttttattattagcaccaggcataggcctccctaagactatttattgacttgaatcattttagtcaacactgcatgagtgatggagagaaggctcagaagggagtacatattgtgaacttcagtgattccagaagctaagcatgtaacataaacagtgatgcaatagttttgtgtattagcaggggtgatgggacttgtggagaactgaagacacaaacattcccattttaagcattccaaatgaacatttttcagaaagcatttcatgagccacatttaatatgtctaagagccaaatgtggctcatggactataaattgtcaatacccatgctacaatcctacactgaaacttgattccaagccagcttcaaacgagcaagagaaaaagtgcacatagggttttttttttttaatattggagtctcttgcattttttgtgatgttatatgtgtgatttatcttgtaagaatacagacaggaagcattagacgtgtgagagtcagccattcttggatgatgtcatttcaaaggaggcagaaagaaacaggatgaatatatcacttaatatattcacattcataaattgttttacactcactactattgaaatgattttattttagaatgctttatatgttagaatagagtttcaatcaagaaaaatgtaacagaagccttttccttatgttaaagaagatctcaagtagagtaatgagctgttagattgaaaagagctggagactcaaagtttttctctctgttttctttcatccctagtgtatagtctttgactttacagtccttggtgattgctagagatccagttattgcatgtagctttctagtcatctggacagagaatgagaaagctgtgactctgtatttcttaaatggtatcttcaaaacatttcaacttatttatgcttggctggaatttagtcatatagtcacacaaagatgcaagaatgggtagggaaatgtttatttgtaggtggaccatggttctgtgatgctctactattgaggaaactagaaagaattttgagtgatacactttgataactgctcatttctgagcagagtgaaaagccaagaacacaacagaaatgtgtgtgcatgtgtaataaatatataattattatctagaccacagagtgaagtgtcactctgaatacttatctctctcttcatgggaggttagggaatccattagattgaccagatattcccccatgatttcgtattgcataaggggttgcctgcagatcttggtattgatatagctttcaggtcttgtcctctttaaacataggtggtaagctcggatgtgctctgagaatcaaacctttgtaggtgagctttgctcacactggcgaagcactacattatgttgttgaccagcctgcttctgatactggtgcagagaatgcagcttctatgtaccaagtagaaaccctgggacctttggtttcctagtgattcattttactcatgaggctgactgaaatttgttggtaaaccattacaaatttgacatcatttgaggaaaagataagccaaagcctaacctccacatggtgttaggtaaataattctgctacacagaggacattcataattccaatatatttccaggtaaagttgagttcctctcacatgcctcctattcctatttttcatacactcaacatcattacgtcaagcctgggattgattattgtgaccatcccaaacatgcattcagtgaaagatgggagactaaaacaggaagagcaggttttgtcttgaggagactggaattgtgctaacctgacatggcagtatggaatcattttaaccatacagtttgctccatgccaaggataaatcatgtgtctgtggcctcattgggcacttgttagtgttggtttgggaacattttaacctaatgatttttgattctgagatcacaacattgagaagtgtatgtttacatatgagagatatagtaatggtaaaaggaaaagattagaattgttagtaagtaatgtatgatctaaatttgggtaggttgtacaaggttatagaacccaaatttatcctagaggtaactaacattcttgtatgtattattctcaatgatttgttttggagacctggatatgacatgagctattatcaatttactgaaattttgagttctttgaacttttttccatgggtgtgtatacgtgtgtgtgtgtgtgtgtgtgtgtgtgtgtgtgtgtgtgtgtgtgtgtgtttgtggtgtgtgtgtgtgtgtgtgtgcttggttgtggatacacatgtacgtggaggctgtaaattgacattaggtgtcttttttgcttctcattcctactttaaaatttactgttagtgtgtgcatgtgtgtttgtttgtgtgtgtactttgtgaggtcagttctttccttccatctttgtgtgggttctggggatcaagttaaggtagacaggatgtaccagaagagtccttggccttcaattttaattttttaaagagtatccatttagccgggcgttggtggcgcatgcctttaatcccagcactcgggaggcagaggcaggtggatctctgtgagttcgagaccagcctggtctacaagagctagttccaggacagtctccaaagccacagagaaaccctgcctcaaaaaacaaaacaaaacaaaacaaaacgaagagtatccatttatttttattttgtgtttctgagtattttgcgatcatgtatgcgtatgtgtgtggtgccttcagaagccagggtgtcagatttggaagtggagttataggtggttttgagctgccacgggtgctaagaaacaaacttgggtcctctgaaagagtgacaagagctttcatttgctgagccagctctcttgtccactcagttttgtttttgagaaaggatggttggttcatggatggtctaaagtggatggcatgtgagtttcctgtctctgccttccttttgctaggaagacaacctgactttttatgtgggtactgcttatcctaactcaggttctcatgtttccatggtaaacactttaccaactgagccatctccatagtacatgatcatttttataactaaaaattcactctaaaattagaataatctgaaagacgcagacaatttccttgcctttagatgccataagactgaagagctatgttttccatgccccatctacatggggagcaatcctgacaacagaagctttgtctttaaggtgcaactgtatgggacatttttatcttgttctaatctttataaataagctgtgcttcaaattaatatgaagccatcttctactgaatttattcaataggggaaaaatccagtgaagcaatactttcctaactacaccttgccttctagggagaaatcactcatgtccatagcattaataaatgaacacaaatacattcatggaactttattccttcaacattttggtgtaatgtacaaactgaaatgtttacttgttcaaagcttagatctaggaagaagatagcatcatagttttcctttttatggctttgttttcaatcagaactgtggcttcagtttttagatgggaactattgtgcccttggttacttctcaaggagagtcagccttgatccctccactgtgtatgagaactgtattcttggcattgttgcagctctgcaaccttccaagtcctttgcatcttcaccaaaaattgtaggaaataagacagccttgcaaatggagtctgaagctttaactgaggcacaaaatatgaatacttattccagtcgtgacaggtataagctccagcagtgtaatctttttccttttaaatgcatcttagactcttttgaagtattctatggatttgttctgtagcttgcttgttttccatctttctgaggaactagcatcaatcatgacctcttcaactacttgcctatttgccctcggcactttcttcctagcctcttgagctaggaagatggttgagcaagttcaaccatctcccagaactcatgtctcctttctgagcacaagtgcttctaaagaagagtagttgagatttctgcctctgtttcccttcccttgaatgcctcatttttcccacttgactctgactttgacccctcccccactgccagccccccaatgcatgtaagctggtgcagtaaggaatcacatacatgctaaatggatggcctctctctcctcagtttataaggtctttcttctggattaacaccattgaccactctagaatttcaaaaatgcagttctctgaaggttttccctcccctccctgactttcttttcttgttcactcataggactcctctttttctcacactagcttttttttttttttcttccttaatggttctgtcaggatattgcctttttagatcatctaggaagcttccacattgtcaagggttttgcttgctgactagtgttaactcataactctcccaccaatcccaatctttcacatgaattctagagtatatgtctatccacctagaaccattttgagtttatgtatctaaatctgtctaccttccaaggttaactatctaccctccaagaatgagctactttcttacatattacttatgtcagttaatggcaacatcattgtgtcattcagtcaataattttccaacctgtcacgaattttcccgtttcatttactaaatatttctcatataaaaataactcttattcacctttattacaaatttctcagttcaagccctcatagtccatccctggggttagtgcaatgccagctaaattcatattcttgtctctcttgtggccatttcctatcagcacctacatgcaccccgttttttaccagtgcaatcccaaactaaatgcaagcccatttttactttatagttcatccatgggaactcagtttgaagagatagcaaggttcatgcttgttagcttgcatgcattcttaatgtgacttgtcattctttacctcacaataaaatgtctcttgtaattctcacccccaaagtgctcatgcttacccttggacgtgcatgcacccccctccacacacacacataaagatatgcatgtacacacgaatgcacacacattttttctttttccaaacctctactcttcagagtgcactgagttttaattttctcttagttgaacccagtgttcctccattattatcacacagaagttagctcacctttccattccctgcatgagccatatgtgaagaatttcttcctttgtgtctatttcaccttttcctataagatgcattttttgaaagatgttatgtttcctcagaatcatccagttgggcaatttattcttacttgaccactgtactatgcttaatatattccattgtttgtgaataccctgtttctttttttttttttaactaaaaaatgtcagaattatcccactgactttcaaggctactgatctcatttcctttatgtaaacagctataattatgctttattcttaatactgtgtgccatcctttctcaggtcatcgctatgttttagttgatttgtctgtaatgattaacctcttacattctctctatgtcttctgagtggtcaagtgtactgaggctaattatttgtcttttgagaaatagagactgtaccatgaattcactttatgtttttcccttttagccaaaaaatgtcaaaaggctcttttaagcctactgtgtgcatgtgttcagataaatgggctcagatcttaaaattacgtgttgttcccacctttaattatctgtcatctctgtagtgtcaaaacaaaagcaaggaaacaaaaggctgctcagtgagcttgttccaggaggctgcatgtcctcctggtttgcactctgcttctcttggattgtttcagaggcatagaagccaaggatgctccacccatatacctgtgccactctgtgtccataccaactcagtctgcttcagagttgattttctgaaaacatgtgaatcataaaagtctcacctgaaaattggaagccaactttgtaccctgcctttctctgggtttacctttgcagtaagaggcattgcttcatggcaaagggatgtacaaggtagctccagtactacctagatatagcagtgagttgagcatctttccaaaactttgcagtgagtttctccgttatccagaggctgctaatgtacttcacttcctccactccaggatattattgtgattgactccagaaagtaaacactgttgatggttaggcactgttcggattctgcaagacttttcttgcttctctgttcaacaaatgtaaaggaaatcacaacaacaacatcaacaacaagatgatgggattaattcaagaggagagactaagataaaattttacccaataatttattacaatgaaattattttattcagtctgcaatacccaatatggttgttctctggcaatcagcattaagttttcttattatgtaactctgaagatatggggtggtctcatagcactgtactttactttagagaattaatatttttcttgctttcattacctgttacatatttatttgcctcttcagtaaaagaatctatcaggtccattcatgttaatttcaaggtattcttaaaacctctccattcccaatttcctaggactttatctggaataagtgacaagctctacagttcaattctgagactcatgtttctcatgcaagtactaaaagttttagttggaattttatgatacaatagatggtggacagtgagattaactgactgtcatgagaaaagaaaatgctttcagatttggctagagaaacaaaatctctctgacatttgcccagaaaacctatattttctttaaaacttcagaatagaaatggctatttcaaggcaaacgaaaatactctgatataataattttattttgcaaaaatttgtactgaaatgaaaacaaaatcagaaaaagaaaaggaaaaaatatctgagcagcggaaaattctaccaaggaacttacattgcagccttatggtacctgtctcagttaagtgtccacttacttactattagagcaactgctatgggctttcctgatggcttgctcagcttgattcctcatacaacccaggaccacaacactcacaggctaggctgtcccacattaatcaacaaaatgtactacacacttgcccacaggtaatctgatggaggcattttcttatttggattccctctttctagatgtctctaggtttgtttccagttgacaaaggtcaaccagcacagtgccatagtaggatgttgttttggatgcttctaaaaaatttcttgggtgctttgtcttttcttttttctttcttaatatgatactttgatctttgccaatctacacatgtgtacattgccattatatccatcttcttctttcttcaattcaacaccccatattacccttccagcttcatgctcttttcttcttatttaaaaaaatatacagcccactgagtccaatgagaatttcgtgtgtgtgtgtgtgtgtgtgtgtgtgtgtgtgtgtgtgtgtgtgtgtgtgtgtgtattttcacatatgaaaccatctgctagagtattcagtatggcagggaccatacctttaaagaaacagacctttccttccacagcagccatcagctgccataagctcctcggatagtgtgggggattcataagccccttcttcatccaagctagaatggtgactagcttgatggtgactagcttgatcttttttttttcttctttcttgcttgctttttttttttttgtgtgagacagggattttctgtgaaaagttctagctgtcctggaacttactctgtagaccaggctggcctcaaactcacagagatccacttgactctgcctccctgggattaaaggcatgcaccaccacagcctggctgactggcttgaccttgagcagcagcctcagctgctgtgagttcatgagtgcagcagtctggtcatgtccagagggcagttttccccagttctctgcagcctatggcttttacaatctcactactcaggaggatgctttcttcatcacactcagaatctgttaagtttgttaaaaggggaaatggttggaattatttcaactcataatatagaatcagggcaaattgcaacagaattaatccaagatgaaccaacgaagacattccaggttccactgtgaatatgtgtgttcagataaatggaggatgacaaaatggacctaagctagtacaatgtatgctatttccatacaattggcatgtaaaatgtgactcatacatttggtaaatatgtaccttacatggactgcctcatattcctgccatctgttccttccgtggaatgtgctagaactgtggttctcacccttcctaatgctgttgaccttcaacacagttcctcatgatgtggtgacccccaagattattttctttgctccttgttaaataaaagacccagagactgatattggggttcaagctttaagctgaagatcagaaagtcactagctcttacctctaactcagcttagaccaaagggacaatcctcaatctgcttccgacttcactgctctcagattcactcagactgctatgctctcctccatgtggctagagactaattctcagactgaatgcctctaccttttatatctctcaaatcctaagattaaaggtgtgagctccgatgcactctccagtagcctacagtggtcttggactcagagattcatctgcctttcctgagtcctggtattaaaggtgttctgagtcctggtattaaaggtgtgtaccaccactggctgatttctataacttgaggctgaatttgctttctgaatcatcaggtaagctttaataaataacaaataatatactcacagctacttctagagggtaattttgctactgttatgaattataatgtaaatatctgtgttttctgatggtcttagaagacccttgtgaaagcgtcattcaaaccctaaaggggtcatgacccacaggttgagaaccactgtgctagaaggaagagcaggtccaattcttaataagaaaaaaattaattttgatatacatgacattttaatttagtttcatttttcttaaaaggggagcatttttaaatttctctgaagaaaaatgttcagagttttgataccatatttacttttgcttctccaagatcttatgttgcagctttgtatgggtgccaccttctattttgtttatttttttatttgggttttttttgggggggggaatttgagagagtctctctacatagccctggttgtcccagaactcactatggagaacaggttggccttgaactcacagagatccatctatctctgtctcccaagtgctggattaagccatgtgccacaacactcagctttgggtaccatcttattaaccttcttaaattttacttcaaatttgagactccctcctaccttgacatcctttcagaattgcctgctatcgtgtttacttacattctgctctacagggaactaacatgctttgcgtgctctcatgtatagatccagtaatagttttttctgtaatgtgagctccttaaatggcaatttgtattggagacatttcccccaatattctttggccaatagcatgtgctgataaagtgtctcattgactctggagctcatctctggagcatgaatttcagtttgtcataggtactctacccttgtcaacagattacccatcagaacattgcaatcacctcaattctattataacaggaactgaaaattttaagttcttcagaatgtagccccaaagttgccatacaagacatgcctcaggtgaactggtcaatggaattgagatttacttcccaataaacaaatccctgtaataactttgaaactcgtgcttctgagctcctcttctttacccctctgcctgcactgccttccttctcctgctataggtgattaaacattttggtttgtcttttctttctaagaaatctcaccagcaggattcaagtcaaccttgagcaaactcttctggtcctgttcagtcagcactgtgtgggcatcaggagtaagggtttagagagcataaagcccatgggaagaagggacccctgaggggctgcaagcaattctgatcagttgagtgagacagctgaagtaaaagacaataaaatttcaatttttctgtgagcaaattgtagcttcctctgagaaggtggaatctactgtaatcattatctctcccttattcaagtctcatcagaaagcttgtctcaaagctatcagctctgaggtcctgtttgtagcatggcatctctttttcagtgggttgaaagtgacttggagcaagaagctgacaaaaatccccagcaatcagctgagtgtttatacaaaggctccatcttctctcagacttgtttgccttctggtgtattttaagactctgcttgtagagggggaagcatgcagttaccgagatgagagcttcaactaaacaggctgtaactttctttcatgaatgaattgttgaaataattttaatgaaaagcttctaacttaacgagatgagagcttcaactaaacaggctgtaactttcatgaatgaattgttgaaataattttaatgaaaagcttctaacttaaaactggaccgggacacagggattctacgttctaattgcagctctgtcatggggtcacttggtgattttgtggaagtgactcaaattctctgggcctcagaagctttcttcaaaccatgtggtatagtgttgttaagctctgaaagcctacaacgacagaggatttatgtaaattttctccaccaaggtcagactaaatagtagttataatactacagagtatatgatgcacacagttgaatcattgggaccacaatacatattttctgtgggtgatatgtttgtgtctttttaaattagggtttaaagttttgatccaggtttctagttatttcttggaggatgcagttatgacttacagatgctaattttccccaacaacataatgttcctactaagctgacagttcatccataatgagatagcagtgatcgtatagaactaacaagaaagggtagaaggtaaaaagggaagagagggagagaaaaaggaggatttgagagatgaaaggaagcatcatgggaactggctgtggaccttgtctgaagagtaggctatagaattgtcctatttcttctagttcttaatttcttatttttttgcaataatgctaattggaagatgtccagtctaaatatgtagctgtgattcactgtattggtatttcctgagcccagaacactttagaccttgctgtttgctcttctttcatttttgtgtttctctcccatttcttttcttcacaaaccatgaatgaaatatgtgaacatttttgttccagagtcctgatggaatttcactctgagacattcattctaagcaggaaataagactgaatgacttactggcagacacacaatccctctctattaaaaaaaatctctacattgtatttggagttcaaatgcatgaaatattaagatcaaagtctgatagacaaattgtagaatcagtcttgttgcctaagaaaagatgaatgcataaagaaaatagagtatgtatgtacaatggagttttatgaagtatatggcttccctattcatgtctcatcatattttagcaataaagtataaaattatgtcatttgtaagaacttagatggaactggaagtcaacaatgttaaatgaaatataatgcatatctagaaataaaaataccatggtttttctcatataccttgaattatatatatatatatatatatatgtaattatcatataacatatatacatatatatacatatatacatgtatgtatacatatataaatatagcatgaaatgtaattatcatataacatatatacatatatacatatatacatgtatgtatacatatataaatatagcatgaaattattagggggactattggagaagagggatgggtagtgggaagagagagtaaggcaggaaaggatgatggacagtgaatatgatccaagggcatgatacactttaggaaaactgacactcaatcccaaatgcatccatgctgaattagagactacaaaaagagcacagtgtcaccagctgaatggactcttcagtaagtaagagatgtacttggccatcagaaagcacgtaaatgtaatttgcttttttagggaatataaagtcattttatccttaaaatctggctaagtgaagttttctgatggccttcaataacatatccacaaaattaaggaccaaattaaaatttctaggcgttcaggtatattcaaatacattaacttctgaactaacttcatgtaatagccatttacatcattatatttgactgaaatccaactcaagtaatttcttttatttgcacactactttctcaacatgagggcctcttggatattaatgaaatgatgagcatgatctattaggttttgcactgtattagtataattttatactaagaaatgcttatagtgatattaaagtaaagcagaggactatggtttaattaagagttcatgaagttcttggcttggaaatgtttaatctatacacgatggtgatattttctaccatcattagtgtaatataacatcattttctacaaataattcattactatagtaccagtcacttctcttatctacaggaaatgctctgatgagtctcaggactgcatctaatcattattgagcagttatttataatatttgcaattaaaattcagcaaatattcactggatatctactatgtttgattattatgctagattatagaaatgccatagtgtataagacatgaacttgttgcccatgaagagagaggtaaagacatagaatacgaatgtttaaaaattaaatgcccccttaaaatttcctatttaagtaaaaaagaaattataatgtatgactatgtcatattttaaatagtttatgatcatactgattttattgatgctaaaaatgttgtcttcaaggcaggccatagcagaaggaatagggaattttgaacaaacccttggctaagatttacttcaaataagaataccacaaaatatttagttccattgaaaaattagcacacatttttactttttcatccaaagcacattacattccagtctctcttttactggtatgtatgacaagacattttgaggtagacaataatctagatgagaattccatttggtagactctgttcagtaagaatgcaaagccatccatctatcatctcctcaaacaggtagcagggtcatgtttgtgtgattattattgaagataaattattgtatgtattcttgtgccttttatatattttatttaaatgttcttagaaagtcctttagtgaatgtttgaaaatattctgtataactgtttggtatttgcttttgtttgcagttaaacttctctatttctctctctctttcactttctctctctctatgcacacacacacacacacacacacacacacacaatctgtatatatacgtgtgtgtgtgtgtgtgtgtgtgtgtgtgtgtgtgtgtgtgtacattggtgttctgtctgcatgcatgtctgtgtgagagtatcagatcagatcccctggaactggaattatagacatttaggagatgcctgggaattgaacccaggtcctttggacgagctcggacagtgctcttaaccactgagccacctctccagcccatctatatatatttttaaggattatttacttttgtgtgtgtgtgtgtgtgtgtgaaaggggggaggcattagatgtctccctctattactctatttatttgaggcaaagtctctttgtgaatttaggccttgctaccctcaacctcaaaattcttttatcattgcagctttccaaatcctatgatcacacaacccatctctaaattctccttttggaattttttccccaagtgtattaaaacatgcaccattaacaaatcatttgagggctaaagaaatggctcagtggctaagagcatttggtgcacagtcatgaagacaagagttcagatgccagcacccatgtgaaaaccacatgccctgtacaagcctggaaccccagctctgaagggcaaggaagcaaaaaaaatggctgggactttctagcttttagactgaggtcagctggggtactaataaaacaccatctcaaaaagcaactagccatctcaaccaccataggaacaacaacaaagaagaaaaagaaaataattcaataaaataaataattttagtatggattgtatttggagtaccatatattccagaaacaacatgtaggaaaaatatatatgtataaaatagtttatgatttctttagactatgcagaatatttggctatttccttcaacataatatgcatgtcatttatcaagatggataaaatacagttagaactgtagtcatattactaattgcttagactgaatttttttgttttctttccatcattcagtcactatggcaactcatcttcaactgtaattccactacttcattgaaaattttaagtgatgtattaaactgtatgagaactaatactgcatgttctgctggctgttttagatgttttataagacaatataattttacattgtgaatttagagtaatttatagtagataagtattcataaaaatatatctgagagacaccaaaagacattcaaaagagtttttttatacaaattaccaatttgagataatattattgaatataaatttgcatttctttggtgcaacctctgtaacaaggtagggtaaccttttaaaatgactttataaggctaagaccatggatatatatatcagaaaaccaatatttaatgttttgaagttttgaagtttctataaaaggataatatagaaaaataatttaatttgtcccttgaagtgtaatatgaattattgttttgtattcttttctattttaagttctctaattctcaaaatacatagtcagaaactgtttctttaaaaataaactttacagttaaaaagatgatggctcaccagtgttaaaggtagatctgtaattccattactctggaggcagagctggtcccctgaggtaagctggctagcaagtccagcttgaactggatgagctctaggctcagcatgaggccctgattcaataaataagtggagtgtgattgaggaggaaatgtgacgtcaacttcaggcctctgtgcacatatatgtgcacacacacctggacacattcctgtgtctaaataggggaatatgtatacacacaacacacacatacacatgcaagggagagagagacagacagacggggggagggggagtgagggagaaagaggaaaggagggagggagaggagaggaaatattggaaatattttggccctttaaaaatgttaaatttggcagggtggcggtggtggtggtggtggtggtggtggtggtggtggtggtggtgagttcaaggccaacctggtctacaaagtgaattccagtacagtcagaggtgtaacacagagaaacctgtcttgataaaaccgaaacaaacaaacagatagatgtttaaaaaacttttattgagacaggatgttgtcctagtcccagttggcttcttcccactcccccaagatttacttatttttattttatatgtagtagctttccctgaatgtttgtttgtgtatttatcatatgtgagcctggtgccctcagaggtcagaagagggcatcaaaaatctgagaaatgggagttacaggctgtggtgagccaccatttgggtgttgggaaggaaactaaacaagtgtttttaattgctgagtcattgctccagctgctgggctggtttctaggccctggtctgcttgtgtccaattcctgagtatttggattacaggtaagtacaaccatgtctggatcaaaagggatttgaaagcgaatttattcagtaaatattcatgtcttgtgtgtgcgtggcagacacaaacatgtctcttaggatgcagtaatgaggaagtccctgagtacacagaacctgaattacacactggagtgggtgtgggtgaatcatttccaccctctgatctctgtgacctgtgtgtagcagcctcctgtagagtgggacagtaatgcttactgacgaaatcatggctgccaacaactgacctccagatgagcctggattaactggcgaggcgtcctgtgagcacatgagtgaaatgaaaggaagggggtagaagagatgtagcccagaaggaaaatatcagagccagagggagatttgaaggtaccattcctctgattctgacaagaggaagaggggttagggcttcttttaagaaacaggaaaaggcaaagacgcagattaacttttagggtctccagaggccaggcctgtctacaccttgatattagcctgatgcaacccattttggacttataatgtcaaaaactaccagtaatacatttataggcttttcataccattcaatgagtagaaaatggttacagcagtgataggagatgaatacaataatatcaaatgaaagagagacataggatggcactgtgagctagaattgcctgatttgtaagtcttgacaatggggaggaatcattagtcagagaatatatttgaagctctaggagctggaaaaatgcaagaaaacaagtggtttattcacccttccctgagtaatgcaaactccttattgtgcaagtgacacctatttgggattctgactccccaaactccgctttgttgtttaacctgttgtctgtggcagactattattgcagccaccagaggtatagagatacagataataaatgaataaaatagctatgtatgttaatttaaaaggatacttcaacataacaaacgcaagaaagtattagaaacagggtaggtgtctagaatcgtgatttcaaatataatctactgacatgataatatttaaatttaaattaatcatggtcgaaattataatgtaactagtggctctgttagtacagaccttagaactatccatcatgacagaaatggtcttggccagtgtcattctgaatgttgtacaattttacatagggtggatccagataagaggtgggtatgaggaaggaatcaggcatgagacagggttctaaggtattccagggggaggagcaaactgcagagttataaaatagataaaagacacatgtgacacagcacatcttaaactcatcagaatgttctagtaacacagtattattttactattaggtagtggcaactactcattcattcattcattcattcattcattcattcattcattccattccattccccaagcatttactgacagcatatttttgtgctgaatttttgcctggtaaatatgtacacaaaagtgagtgttcacctgtaagaatcaagtacaataattattctcttgtaaaattcgtagttccttttgatggtttcagaggtcattggtttgataggcagagagctgagctacaattctgtattcttcttggttgaatgagggaagagggaaactggaaacattctcctgtgttgggggcttgacacttgtgtaacaccaaagatgtctctctggtcattttatgtccccttttcaactctggcgacaacacatagggcagcagcggaggcagcacgaacaagagtcaccaacaatgttccattaaattgtaggcttttccagtgagccttgaactggagacttggtcttgaaagtgtattgttcccattacgctttcatttttatcaaattttgcagctaatgacaataactttcatctgttagtaacagcaagcacaacaaattgcatctgaatgcagctttcttccttaaggaagattgaagaccttgtgagagtgcacttctacattttttgtttccttagttttttcactgtaaaatatgacctgattatactaaaacattaacatataaaatgttattattaattttatggagagtgccaaagtgtgcagtcagtgaataccaactttccatagccagggaatattggaaagctgttatccaaaggtactgcggaatctcaggaggtctgcatgggaactaccttttaaggcaaatgtatcttactggtgaaagtgatggaggatgatttccagatgttgaaatgcttgttttggcaactgctgcagaaaaccaaaacgcattgccagaacaactgaaagtgatgtgaggcactgatctaagaggggttgggcacacacaaagcaagacgtgctggattcagagaggagatccaggggacatatctgggtgaagggagctgtaatcagagctgaggaagtgcatggagtgaaagtatgcgggcctctatgttagaatacacccaagctcatctcattagtgctatgttctccactttcctatactgtcttattatcttccccataaccatcgacattatggtagtgaccatagtaactatacctgactagtatcttgtcacaggttatgaggttagtgaaatatacttggtagtggaaccaccaagtaacttgcctttaaaccctgcatccattattttctactaaaatagacttgattaagtctattgctctctacagttgtttcttcattgtagaatgttatcagaaatggcaccaccgctacggaaggaagggttgttataggaaaaatgaaatgaagtgaggtcctttatctgacccctttcatccagcctccagaattaataataaaaaagatacatttttcaaagcaacccagattttattttcttttagtcagattgactttccatgagattttataactgtctcacagacaacaaagtactctgttgggtgttgttttaggcttgttttctaaaggtaagaagtgctaaaacaagcatcgatctttgattaaatatttgtgttgaccacagtgcttctttctaccaccattttaaatgtacacgtggagtttcaaatggaggcaagaaattgttgttctgaagtagtcagcctgtgttgacctgctttaggtaaatgagtattcatctaactacattttcgtgaaccttttccctttatttctaaattgttttgattacacctttcccctgtacaatgctcttcacttcaactcttccataaacaaaggcttcttggcaatctctgttggtaaccctggtcctgggccagaaaaggccagccccttccaaagcgttagcctctgcaggagttggagcctgagatcccaattcctgttccaactattttcacaaggagtggagcaatagggccaggataagaagcagagacctctatagggagctaacagttcaggactggagaagtgagtgggctttactgcacattttctcagaagcttttcgagtgttcgtgttgaggaaagtttcactgtatattgactttgctgtaacttggtttaccatattctctgtccatactctttgacctactaatttacctaaagaaatatcagacacatgagccagaagattttggaatcttgatttgttgtctagaaatcacagactgttgaccttacctatattgtgcttggagttagctaaatgatcaattctttttatttgaaagctcttgagtcagaaaaggagtgccatagcttcttgtgtggtgttagctagcagactcttagacccagaaatgcaatttacaatgatctctgtgtttatgcaatgtctctgtgacaagcaaagaggttttaaaagcaaaatgactttcatagcattactcacaaagagagtttaccaaagctatttagaactatgaaacacgtgtaattagtggaagaatctcagctaaaatagaattttaaataattatggagactaaaattagaggccacactagtgggtctttgtagttaagatataaagaaaagaattgttgagtaatgtgtgtgggttttattcattttcttttttggcagtttgaggattgaaccaagagccacacacatgccatgtaatcactgtgtcacttagatacagctcctgtccctgttgtttagatgttaatgcaagcacaatttgataattcattttggaaggtgactacctgaaacaggatcttaacagaagagataggtatatgccaggtagctatccagtctgcacgtgacctttcatttttccttaagcacttcatgtctccagtcaagaagagtacaacagaaaacacgtcactcaaagcctaataattttactactagcttttttggtgaaatctgtattctagatcatgtcttcctaacttcccttggtattatgtaattatttaatatttacataatattaattacccagccatttgtaacctaccctagactctttgacaaaagctattttagttaaaagaagatgcattttggaagtacatacacaatcaagaatatggaaaatccattgtaacagtattggtgaggttatcatgtctaaatcacagaaaataaaaataaatgggaagggttattagtatatctcaaaatgtttgaaaaagctctagctatggaagtagagttgaataaaataagagaaaaatggcatttatttctctgaacttcaataacttactagaaccatgtggtttagaaagcacagatagttcattgcttccaatgacacattcaaagagtgatatacagaccatctgctgtgggctccatatttatacactctaatatgccatgtggcattctctatgaaagataattttaatactttggcctaacaaaatggaacaggatccctctgaggcaacatattcatttttgaaagcagccagtcaatgggtctattaccatggatactttagaaggaattcctaagaaattagactaaatagtgttttgttcttttctgcagttttttttttgtttgaatttagtggcccagtaactactgaaaaggtccctaagctcattgtaggacaaaatcctgggaagaataggggagcatttattacaaacagaaaggaattttttcaaagatcatttgtaaaaacaggagtgaagaaatcagaacttgattgaagttatcttttaattaaaaaaaaataaccactgcccacagagacactggtattttaaggtaacctttcaatctatgaaactttaagaaatgaacatttttacatctttaaaatatttgtctcagaaagttcattaataaacgtgagaggaggggaggccgagggaatgggggtatggatatgtaaatatgagtaattaaaagaaattaaaaaaataaattaaacatggaaattctttccaattcactatgtcccaaggtttcataaaactgaggtgtgcttatgtactaatatgtgacagttagcaagagatccatttgcctcgtgtacccagtcacttgtcacaagagcattttctgatataatttattgcttgttaagccatctctacagtgcagttgtaatgtagggaaggaaacaatcactgatgtttagtggccagactgttgactgctttcttttgaccatgtggactgtgagttggattcctgaaggacatattgttcaggaatgtttaccagttaagaatgatggctaattttccatattgacctcatacataattacataaattaaagcaaaccataacaactgaggctacacataaaattttacagcccctgccttgcactaagcttgaaattacatgccatacagcacatacgtcatttttggaaatatgtgtttaaacccctcctaaggattgtaaataaaaggtcctcttttagaatatgccaccatggagttttcctcttgaaaagtctggttactgagatgacttattgggtaaaggtgtttgttgacaaacctgatgaccgaattacattcctgggacctacatggtaggatatggagacccacagcagatgtatgctaagtaatgaatacatcattgaaaatgacctacctatgtttcctgctaccgcacgagtagtaagttgttggcatttaggaaactaaatgccagccctgggacttaaatgtaaccaacatccacaaactactctctgaccttcacatgtgtgcaattgtaaatgtaaccaacatccacaaactgctctctgaccttcacatgtgtgcaattgtaaacacacatgcatacgcaagtgtaacaataagtctttccgccatggccacccaagccctgcttccatgtgggcactttctgccaggccgcccaagttctgcccactgctacattaaggtctcaagtaacacacagagacttatattaggttcaaatgctgcttggctaatgactagaatttctcatctgctagctcagtcttaattatcataaatctatatattttataagacttatagaggatgccttccgctggcaccctctcttgctggcagatcacatggtaactacagagcagaaaccagtaggaagagagaagggaaaagggcgacttccttcttgcccttgcttatatactgaatctgcctgctatgtcacttcctgtctggatctttttactgcatttcccagaatcctccttgactcctaatcccacctatcttgcttcctcattggccaaacagtactttatttaacaataaggtaaacatacacagaaggacattccccatcacacatgcacatacatgcgcgcacacactcacacatacaaatataaaattttattcttctattttttaaaatttgtctactaagtaagagaaaaggagtatgtaaaaccagggacattttttttatctacttactcatcaatttgcttttcctagaacataattacttgataaaaatttctaaagctgggattccaatctgctttagctcctgcctgctgtgtcagagggatgtaagaccgagttaacacatttaactgttaaataataaaagactctttgcttttgcatgaaaaaaataaaactaccaaataatccaggcggtggtggcacatgcctttaaacctagcactcaggaggcagaggcagacagatctctgtgagtttgaggccagcttagtctacagtataaattccatgacaaccaaagttacacagagaaaccctgtctaaaaaatgcatataaaaattatataaaactaccaaacaatttttttttggttttttgaaacagggtttctctgtgtagctttggagcctatcctggcacactctctggagaccaggctggccttgaattcaccagaggcagagttccacctgcctctgcctcctgagtactgggattaaaggcgtgtgccaccaatgcctggcccaaacaatttttaaaactggaacagaaatggggagtttttattgaacccaatgaatagagaagtcatcttttattgcatttataatttgtaattacaatttacctggacaggtagcccatgtaatatgtgatttgaggggttggtgatgtggcaagtaattgctttttcttaatgtaatcataagatgtcacaagtaaagttgcattgtgtgcttctttaagaattacttgtgttccaactttgataaaatgtataccccacactaaatacattaactaatattttctttgtgattgtggagacatttagttatctttcaaatattaatgtttcaagattattaatcagaaagtattattacattcattttacctctaaaatgattttgtttaaagtttgcagtacttatcttcccagctaggtgctggagcaacatacaagattaatgaaggaaaaccctttattgaagcctcacctgttttttttttctttctcttttgtaacttctactctttcccaatttcatacatgtacgctctatagttccgtcactctcccatgtgccctctcctatgtccttcctaccccaaacatcattccttcctcctcctaatgtctttccattctttactgactttagttttgtttagagtcccagagaatttaattagggctgtcttgtgagtcctatgttaggaactaaccattagagcctgactggctcaacactgggtataaaactgggtactatgactctctttcatccagaatccattatctaacaatcagcaatgtgtgataaggccttgaactccctttctccctctataactgttaggaggaattaacttttgtggcccaaatgctagtatagacaccagtgagtttctcttgccatggctgtgtcaggcttagaagatagtattgctcagactttcttctcattctccagttcttacatttctaccatcccctcttccatgatgttctctgagcctttaagaggtggtataaatgtcttgtttggggctattctctcaaccatcctttatttttagcatctgtgcagccacaggtcttggcgtttacctctgtttactgcaaggagtggcttctagggttaaggctgagagtagcttctgcctgactcaagtcagatccaaacagcctgttttctttttttgataagaagaaagttgacatggctttggctggataaataacactctactttccaaaatttttattagcattgttattggagacagtagcagaattaaaatgagctcagtgacccctcttatagtttaggaatttttactttggctaaggctgaagtctatgcaaattaatgatctcttatgatggatcatgtttttgagatgaaacatcttcgcagacaaatgaggtttcagaaaaaaagctatgattatagaatatatgacattcctggttgcattttgtcaacttgacaacagcttagacatatatggaaagaagagaaaggattgagaaacaagattggtctgtaggcaagctgtgggggcattttcctgattaatagttaattcaggaaagcccagcccaatgtatgtggtgccagccctgagcagatggtcttgtgatgtataaggaaaaagaacaagttaagaggagcaagccagtaagcagcactctcccatggcttctgatctacttcctgcccttcttgagttcctgccctgattctttccagtgatgggctattaactgcaagtgtaagatgaagtaaaccctttcctccccaagttgctcttcatcatggtgttctaccacaacagtaaacagtctaagacagaggctttcacacatacttcttgccctatttatatcttataattgctaattaaatctttttgattgatgcagtacttagacaccattagggatttcatgctttttttctttaccaacttgatagtattttctttttaaactttaattttcatatttcaagtctcatggcttgttagatcacattcttgttgatttctttaacttcccaggctcaaaattgagactattttatgtatggattcacccagagttcatactcttttgtgtttgtttgacttttaatgacatcttgtttatttctatgtatatttatttaaatttagaaacctaacatgaatgctacttttctctaagttctagatattgctatatgtgtgtttatgcataatatgtctgtgtgtatatgtatagttttcaaaaatgttagtattaaaactaacatcttgcttaggtgtcttcaagaatgatttcacaaatttctgagattatttctctgggtctttttcatctttttatattcatgaatatttactccaagagaataaaaataagttctcttatttttatttataattctcttgcattatctcaatgcaaataagttgtccataaagaagttcattaatccctcatatacctatcaaggatcatccttaaggatagtcacttgtaatttttttattttccagaggagttttaggattatccagtattatctgtgaagatttgggtcccagtgctgaagcacttcattaccggctcaccagatagatgttgcagatagtaccagacagagagaaatatgctttcatctcctccatactcctttcaacttttctttctctctgtccttttgttcttaatcttgttatcccaaaattgactggggcaccccagtgtactaaatggattccaatataaaacccaaaaatatcactctgatactatgtatgataatttgggtactgttctatctagagtagttatagcatacaaaatcttgaaaagctcaatatctgggcttctttctacctgaagaaacacttttttggagatacatgtgtcaaagcatctttggaatccagtggtaagtcaatatttaagcagtcttgttctgatccatgttatatactctttaaaaatacagatacactacacctatcagttcttgcattaaatgctttcttagcttgacaattgtaacagattatttaagcattgttttcctttccaggcctctgattccctttgtggggtctgttatagtaagcatatacaatgtatgtatcaagtcgatgtagtgaatcccaccaaattgcatgtgtgtaattaaaatttagattatcagaatattcaagggattctgctaacaaatggagttaagtttgacaattcttttttttttaattttggctaatttgtttctaagcagtcacatgattggctcattgttcaatatctaacccttaccttctgtcataatacttgagaaactagtttctcaagtatttctctgtatcaaattttatgaataattgttttcaacaatttacttaatatttctgaaatgcccattgaaactatactttaagtattgaaattatcaaataaataaatcaaaagggactaaaaactaatgacccattgaatattctccaaacataccattttatttttaagattccttcaggttgtctggttggattcctttcttctatttgacattttaaagaatcttcttgttggctttgaaattccttgtaacatagcttcacaaatagttttctggtctgcctaatttctactggtctctgacctgtcacactttggaagcctttctttttccttcatttgcaagctttccttttcatgctatttctctccatagtcagattttaaacaaaagaggcaattctattctcagactgcttcaaactccttagactgcactgttcctcatactgcactgctctcagattgccttttacctagactgcactgagttcctttctcctcctgccttctattcctctctccacccagtggtatcactcaggtctccacctctctagggctgggattaaaggtgtgggaccccaaatgctggggtcacctttgtgtgagctctgtttcttttttagacagattcattctcgagtagccctggacagccttgaactaacagagatccctctgcctttgtcttgcaactcctgcaattaaaggtatgtgccaccactgtctggcctctgtggctaactagtgtggctagctttgcaatctgatcttcaggcaagcaaaatatcaccacaccaggcgtctaatggttacttaaaataggctccagaacttctgtggctcatcaaatatattaatttttacttgtttaaaaataatgtaggattttcatttttttcctaaaattaaattattttgtatggcactcctattttcaccaaacactagtcctgattgtaaacaggaaatacaagtgcacatctgtgatatggcaccaatccctgccctactctgtctagatgttgagaataaaatttaagaaaacagtcatttagagtcttcttgcatttaaatatgttcaactgactgataagaggatgagcaataaaagtccacatggctactattttaccaattatgtttactttcctaattgttctatactatttgaataattttaacagctagctgtaggtacagtgtaactttaatgcttttagacaataatccagactttaatcatgttatccttaatcaattctgctttattattttttccaactttttaaatttgaattagaaacaggattgttttacatgacaatcccatttcccttcccccaccagtcctcccctacccccccaactaaaatcttatttgtcacatatcttttcttgtcacttatctgtgaagctatggaaggtgaggccttccatagggtgtcatcagagtctttcatatcctttgggatagggcctaggcccacccccgtgagtcttggctcagggagtgttcctctatatggaatgggctcccaaagtccacacttatgctagggataaatactgggcttctacaggaggtcccatagatttctgaggtttcctcactgaaacccaagtttctggggtctggatcagtcccatgctgataatccagctatcagactgaggagcaagagttcccagatgttcaggtcagctgtttctgtgggtttcaccagcctggtctggacctctgtgctcttcactggtccttctctgcatctgggttccagttcagatcagtgattagttatgggtgtcttcttctacttccaccagctgctggatgaaggcatataagtcagtcatcaatctcataatcaggggagggcacttaaggtagcctctcctctgttgctgagatagttagctggtgtcatctttgtagatctcccttagctgttaaaggctaggctcacaaccaaaaaaaaaaaaaaattcagctttatttaactatatgagttttggaaaattttatactacagatctttgtaaataatatgttctcttgagccttgatgtatcctgatagctttttgtaaagtatagtttcttcattgatcatccattcaagtattatctatatgtcctcactgagatcaaaaccttctctgtaggttattgtatagttgaagtacatttaacatggtctaaatttatggtcctttgccttaactctactatgtcattcagggtatgtacaaatatgagagtcacatttttttttcttacatgacaaactccactcattcaatatctttgtggatttattaattttaactgggtatttaaggtcctatgaaaaggtcatgttattaaggactaggggctcaatttctgccttatacttaccttctctcatgtaaaaagaaccttttttcatgtcagttactttcatagtctcacctcatacttcatgtgttagtttttctttatgatctaaggaactgtgcaagtgtttgctttcctttaaagtattgtgtttatgtcatagaaatcctatgggagaaactcttctgctcactagctaataataattgtttaatcatgtctgctaatctaggcaatataataaacgtataaatcataaatgacagataaggctttaggatgtttgcattcatggagtttctgaatcagtctgtgatcaaaataatgtataagtgtcaattatttgattttgaaccccagtaataggtaataatgatgtggatttttattgttcatccttccataggtagacagaatatacatttaaatgtttttagtgtaagcttctattcttacatataatcatgaattaatttaatttagttgcttgtgatttttctttaccagtttgtaagccctcaaatgctttcactttgtgtgtttggagttaaatataacatttacatgttggatattcaactgtggcagacatttaacagatatttggggtctgtgtctataaatatattgtcgtattagtttcatcactacatggaactcttttatactttttattttgttttttagagacagggtttctatgtggctttggaggctgtcctggaactagctcttgtagaccaggctggtctcaaactcacagagatccacctgtctgcctcccaagtgctgggattaaaggcgggtgccaccaacactcagtggttagtacttgccttttaatagaaaccaaaagctatggtggcccatacaaatgggaagtgtacaaaataagcacaattttgtttgtatgaatgcatgtattatcacagcatgtcttatctcatttatccagagcctgagttagtgaagtttatatatcgacatggaggcactcatcacgtccacttttccttatatatggatatggaagtactcaagtccacttttccttatatatggacatgtgcacaatcatcatgtccacttctccttatctatagacatggaagaactaatgtccacttttcctcatctatggacattcaggcaattatcatgtccacttttctacacatgattggactgagatagtagcttgcaatctttaaaggtgattctggttgtagattagggaaacacagctttctatgatgttccaaactcagagaagtgccagttcagaatggatcactgtaatgatagagaattgtctgctaatgcaccccaggagctcttgaaatctcttatcttattaatttgggaggactgaagtcctcttctgtagaatgtaatttcccctctaaagaatctgaggaatcctttcctgctcagaagcaaatagagaaggcttcatctgcattaatcatgctgcttagtgcccacagtgtgattaagtctccagatacttttctatataatataaactagttagttatctggtgtttcagtgtttcatggttttttttttttttaaattttattttattttattagttctagttagggaacaagcttatttcaagtcccttctccctctccctcccctcacccccaaactttctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggggtgttctggtctggggtcgggagcgggcaggagctcactcacctagttccaggtcagtctgcggcgggggctgtttttttgttttgttgcaattgtaagtactattgtatttccaaattcattagtattaaaaacaaactttctgatgagggtgtacatatgcatgtgtgtaactgtgtgacatatagtggattttgttgttaggttatttgaaaactccaaagtattatatagcatatatatctaaaaatatccatgcatattgtgtatgcatatatatttttgtttgactttaatctgagtattattgcaaagattatattgaagccaccacttttccttatgagggtaacctataccgccattaacaagccccgttttgtaactcaaaatttagaataaaaagagcctcattatttctctcttctttcccttgaagaaaatacagcatttgatctcttaactctgtaaaagtaatcagtttcccatccattctttcatgaaatcacagtttttcgtaggggcaaattgtttcttccttttatctgtgtttggtttttgaattactaggaaaactctccagaacgttcttgcactctgtttcctgaggccccagcttcctccacagcagcagaggttctgcttgggaggaatgcttctgagtatccacgcccatcttaccaccatctgctctgcagatgagccacacagcattgttttttgctctttcttcaaggtctgaaaaacagattggaagcaaaattctaacccagtgatgcttagcaaattaatcttcatacttgcatgaagttgctcaggaatttcatccatgagctccgtgtttatttcaagaatgaacacatcacacctacgagtaccatctgcaggacattttcctgctgtgtgacattgccattctttttctgcagcctagctagatctcacaccttttctaagtcagggttaagtgctgctcttctgtgaagtctctcctctgtcttattccatagatctctttcattacccaaaactgttttacacagcattggtgtttataattgcttaaatgccttgtctgtttaatcatactgtaattagcctgatagcaggaatttttatttttttaattttgttttgcagtcccaaaacaaggaacataggccattctgtaaccagttgctgaaatgatactacaccaatgcctttgaagaaacctgattataacagagtaaattataggattaagtctgtaaaaaaaaatgcagtcagaaatttaggaagtggtataactttcttttattctagacaactgggcatagaggaacactgtgaaaacacacacaagaaacaaccaaaccagacagtagtcacaacttcaagctaggtctcattgtacaataagatggggaagaaactctggatcaaatgtcagctcccagtggctactgggagcctctgagagtttacaaaattccccataattcctcagtccttcaccaagacaggtgaagcaggtgaagggctcagtggattaggaggcagataatattgcatactctgtgtggtaggaagctagaggccaagtatctgggaatttatttgtcacattgggagaaaaatctaagtaattcttgctgatgtgaatataggttttgagttggcacaggaaactgatcttaatgagaactgatcttaatagtccagagaatgcggaagtgacaacagtaggagagcaacagacacggcctgtaaggtgtgaatatcaagatggagggcatgacataattcacactgtgaggatgaatttgttatcaggacagactgtgtttgggtacaagaactgaggcttagagaaggtgacatggctgacatgccatttaagaagacaattttaatggctacattgaaaatagatggcaggacagttacagaaaaatatctgtatgtctgtggtattaaacactgaaaaaatggagaaacaagtaaggcaaaatacacacaacttatttggttgactctgtaagcttgccatctgggaaagagtacttaggaaattaagggggtggaataaataatggtaactattatcttttcaatggatatctattaataatacttatttttataaggttaccatttgttaagattctcatgagcacagtgagttattaggcccaatacggtacatccttataaataaagcaaggactattgtaatggcattagcaatattttcttaacgtaagcttcaagtattattttaatagaatcatttgctttactccatttacaaactctatgtcatgcgctaacttcatacttaaccacatcctgaactcctgtggttcacatatgtatttcctgaagtgtgactctagtcagcagtggcccatggggaaattttaaagagcagatgttttaagtttccatattatgtttgcccgtatgctagagaaaactatataaatgatcaaatttgagattatttcacattctgcattatatggaagccaataagtgtatcttccatattatgtttgcccgtatgctagagaaaactatataaatgatcaaatttgagattatttcacattctgcattatatggaagccaataagtggtggcacatgcctttaatcccagcactcataaggcagaggaagggggatttctgagttcaaggccagcctggtctacagctaggataactaggggtacgcagagaaatcctgtattgaaaagcaaatgaaaaagtatatctttaacaaaaaaatacacaaaataatggcacctaatatatacagatgcacataaaattgtagtaatggtaaaatagtgtgaaacatagaattaatttgtgcagtgtgtgtttgccataaaggctaagcatttattataaaaataagatgactaagattttgtgagaggattatacacttttagacatgtctagtgtaaagagtagattttcaacagaaattattttaaacaagaatagctaacatgcaattttatcttttctttcactatacaacccctctgtgactacatattttagtgagtgagagaaccagaaatactaataactcatcccagtcaagttggtcctctacttcctatgattcacacagcccagctaaagtcccagaagaatggactccttgtgtcacatagagaaaactctgagaatgggctcccccttaactccttgtgtcacagagaaacagctctgagaatgggctctccattagcttggtaaaatcattttgcctcaagagctctaatctctttatctgtaaagtaggaaactaatttctgcttcagtttggtataagcatggatcagataagatatgaaaaaaagcacatatgcatatgtgacccgatcagtattagtactgcaggctgagagcgtctgagagtgccatttcctttttctcatatactgttcatatgtttccaactgtgactccacaccaaggaatttggagtcatagttgacgttaccatctgcccactgggcctcttatagtctccactttgccaagctcacagtaaatgtctcctaaaggaaatgcatagagctactttgtagttcattttaaataaaataataatgattatcattaaaatactttaaaagcaaggtatgcttttggtgcattttaagaagattggtttgtttttgagctggaaacttaccgtgtaacttaaggtggtctccaattcaaaaatctgcttgtgtcatcctcccaagttcaatgccagccctgaaatagaataaaggtgtgggccagctaacaaggcgtgtgtgtggagtacttaatggctgaaaatggattttcatgcagctcctctcattgcctttgacataagaattgttaaatggacttttctcatcgaaagaacagggcctaagatagatggcttcttctaggtttccctgatggtaattctagttatattgaaaattatgactgtatcttccaatgatggaacccggttcatatcttatacatcaaacctttacaaggacaggtagcatttagtaaaaaaaggaggggagagagtcaagatagaaacctaaaggaaagtaatgaagtttaattctctggccatcgcttggcagtctttgactaatttaaaccccattcttctcttctatgctgtgtgcacacctgaatgcacacctacaaagtttcagcatccttttactagctcctggaacccacagtgtcactgctatgtccagctctctgttcaataaacacagtcattgttgtgtcaaatgtggcttccgccttacagtgtattaatacatagaacacttccttaatctaaattggaataaaggaaacaaggaaacatacctgtcaggagaaggtgctggagtgggaatcataagggcttagttcagccttggggcctgtgtcacaatttttatgccttaaagcaccagagtatatgtttttttttctattctatgtgcactttatggtgtatttataagccaaagtgatattgttttggtaataattttttaacttagaaatttatctttatttctatgtttgtaaatacctgggcagttttgaatgctaactaattatactttaaatatgcttcaatagctggtcattaaaaaatgcacttcttgaaaacatatcctaaataaaatgtcttaggatgaagtcttcaggctgaatttttttgcttaaatatttggattggctcacagtataaattttccaagggcactccagacccaattctcacccttccaaacatcatattcagaagtaatgaactaatattgatacttcattgttaataaacaacctttatttatgtttctttggcttttagctcatgacctttcctgtctgaggagcccaggcaataccacatcgaatttgatgagagtatttccttaggtgtcctttggatgtgacagtttaccaacctttctttgttttcatgagttggaaaagctggggagagctaatgaggacttttgtagaatgtcactcagttgggatttttttttctttttttttttttttttgtcatgaatagacaggtgtgtgagtatttgggaggaaactttcacaggtaaagtacaatagttgactgccagcataatttacaacaatgatgttagacttgaacacctcatttctgtaatggttaccagttgttttccctttaatttactagttctctccatactgtgctctaagaaaggactcagtgtgaacagcccatattgaaaagagtagagtagttgccctcaatctccttaaagttgtagtatcacaaaaattatttgaaattctttgtgagttatttatctatttgtttatttgtcagtatggattcttagatacttatttatgttttagaactgttggattctatgtccctgtgactaaaccccatcctgtatgccactcttttgaattcagacataactctatcatatgtaacccctttcaaattttccttttttcaaattttcttttttgacattccaatatgatccattttatgtatttctcagcctagtcctaagatctttcatttcttcaatgtggccctgcatcttctattgagggatgatattaaaagtcacaatctatgatctaggtgtatcttgcttctgtatctacttagctgtgagaatgaagatgtgtttgtctatattcatagacacataattatttcagtgagctatacagttattaaaatttaggaaacagacacagtaaaatgacctagactttggcatttcacaggaaatcactaaaggaaataaaccaggccatgttaatggacagtaaaactaggtagaggttagaaagaatatgaggagaatgtaccataagtcaaatgtttctatctggagtcttgggctggatatgtctgcccaagcattttgtttggctcatggaaaactttgtaaacaatttgaattgcatcactgagtaaaaatacagtgggatgtcaaatgtaatgctcccttttagatgctctgagctttgtcaggcctgagactcccacacctgtgctgtctatttgccaattgtcttccacttattggcagtgccaaccttagtgaggaccacacaagcacctcttttccagaagatttactcatcccctcatccaactcaccatctcctgtgcactgggagccaactcaggccccaaatgctcatgaactattgcttctattccaatatgaaagaaaggaaattatgtttttgagcccatggctaacaaatttggaaaatgagaaaaataatttcatttgtctaagtgaatgatatccatatttaagtaaaattgtgaactctattgagatactacatgcaattccagtactaaataaacatttctcagtagattttaacttctgcccaaatcctggttctcaaatgataatcatgagtctgccttcttagccactccttcaaaattgcataagtaatatgaatcaacataaaagttggatctggagggctggagagacagattagagggtgttgctcttgcaaagaacctgatttcagttcccagacccatgtcacgcagttgataactctgtgtaactcaagctccagaggagccaatacctctggcctccaagagcacctgcaacatgtacatatacctgtatagagaattaaaaacacagaattacatacctacccagaattgaaaataatgaacctttaaaatttgaatttgtattggcctgataaatatgctgtcattataagagctacatattaaaatgctagaagatatttcttatgtgaagatagaattttatttttgacaattttttttgtatatcttgaagtatactgtaccctgtaaaaggccagttatctacctcacacactttaactacatctaaaggctgagacttgtggctttgtagagagtttggttagttttaaggctgacggcaggaagcagtggagtgctcatagtgcatgaatatggccctacattcattccccaacactgcaaagcaaaacagcaaagcaaacaaccccaagataggccaatttacctttactgagaaaggatatgaattaagaaaaaggtattaattataacaaatgtttctgacatgctaaagatataaactattgtacttgacatttgacttctgccctagcaaatattatgaaacaataaaaatctgagccatcaatagtcaaagtgcaaatgaaatccagattgtgagaatctgggagtgaagcaagctggcagctccccaattgttactgactgatctaaattaagcatattttacaagacaatgggctcacaatatgatgcaaaaaggtattgtagttaagtgtagttaaaaaggggatgaatttagttaaattcaaagtattaaaataaatgtagcataaagtaaaaaagtcacttgtagttagacaacattaaaatgtatgtcaagtatggaaactcggctttcttctttcctagcctccatactagtgtataatgtgctaggattgtatttcagaatgctcatatttatctctctgcatatatggatatacaaacataaagtttcaccatgtttgcatacatatatagttttatgtgcttataatatttataaaaagaacaaaatctatagctgccaatgtataggtattgctataaaagacaatgtctatatacataatacatagatataaaaactatatacaaatatacatttatcttttacctagacacgtcgtacacacacaacaataatgctttcaggagattttaattaactctcttgaaactgtgtttgagggttaattacatctaagatgtaaaacacaactatggttagcatgtcgaaagttcttaataaatggtagcttcctctcaccactgccaatttaaacaagacatttaaattcacacatttttttattttactgtcaattatgaagttattgaagagaccagtattgagtgttcatttgctcattatttgacattaacctgaaaaattttacaggtttttggattcggctttagtgtttgcaatctaagaacaactggaaagctaagattagtctgtgcattcttcacaataaaacactaagttttggtttttacaccactgtttgtaagcaacagtcatgacaccaatgcatggggttcatcagaagtcattgcactgcctcttttgtgagtggaagtggtagttctcttactgggggaggcattggccattgaatggaacactcaaagtgcttgggttactgttacaaacccccaactgcatgtaagacaataattgtccataaaccatttcagtcataatttacaaataactcaaatatctaggcttgggaagaagaagtttcatattgggttgagattatagcatatgaccatctgtggtaggttctatttagttgtctagcctaaattaaaatttaattacttaaaattaaattttaaatcaacccttctttcttaccttatttgaatgtacctatatttgtaagttgaaatagaaaatggaaataggcaagtcaggaaaattcctataattgaagatttattttatagaatataacatcattctattttatctgttgtgtctgtctgtctgcctgcctgcctgcctgcctgcctgctgtctccctctctctctttcatctgtcttttccagataacccagtgttgtggcattggactatagcactgtcttcagtggaaagattactttggaagctttgcaactaatgcttcttcaaatgtatgaatttgcagcttcatgcaggagatagaggtaaaaagagaagcttggtattagagtaaagcttcaggcagagtttccctgattctccatccattctttcatccaatgttaagggatgtacttagaagtgtttttataaaacaattcacttaatttttctggaatctgtctgtggctgttgctttgtaatactttgattccagaaaggtgttttatgtataattcaaacacttcatgcactgaatgcaaatttactttatgaagaattattgaaaaatatatactataatagagtccaggaagttgtcaaccagttttgtttacattgtcagttaccatagaggacatttcaggctgaagctataaattactattgcttctataaaactgtctgactggagggaggatgtagtgttaggtgtgggacacatactaataactataactgggatgtagaaaatcccaaatacagccacctttgtggattcagacaaacctggtcagtgcaccgattagtttagtcaatttcacacaaccctgagtcagttgggaaaagggaacctcaactgaggaatggcctctactagactggtctgtcagcatgtttgttggtcattttcttgattagtgttgatgttggagggtatgggccactgtgggtggtgcccccctgatggctgaggacccagggttatgttagaaaacaagctactaaatagattttgccatgatctttggatcagttcatgtctctaggtttctgccttgggttcccaggatgatggactgtcactgggaagttcaaaatgaaataaaccctttcctcctcaagttgctttgtgttattgttttgtgacatcaactgaaaagctaactatggttgtcagcatgtgatttcaatatatttttcttgatattttgggaaggttgaggggctgtatcctcaatagactgacatgtaggagcagagttcaagtgcatttccccagtcccttgttcagagagcctagccccccacatctccaccctggttgccccaaaaataaagaaatagggcatgaactcttcagggcagagcaaggcagtgtgttttctttttctttctctctctctctctctttctttctttcttccttccttccttccttcctttcttttgcagatttttttatttgaattagaaacaattttttttttacatgtcaatcccagttccctctccctctcctcctcccctaccaccccatcaactaaaaccctacctatcacatatcttttctgttttccttggagggtgaggccttccatatggggtcttcagagtctatcgtatcctttgggatagggcctaggcccgccccccatgtgtcttggcttagggagtatccctctatgtggaatgggctcccaaagtccacacctatgctagggataagtactgaactactacagaaggtcctgtagatttctgaggtttcctcactgaaacccatgttcctggggtctggatcagtcccatgctggtatctcatctatcagtctggggacagtgtgttttcttatacaaaatataatttcggaacttctgttttgacactgacacttaggtggtgggttgcatgtctttctacttgctgcccttctttcccctcttctgttgataggactgactgacccttcttagctcatagtaggctgcctttcagatttgctgtgtagctccttaaccactcttctgataaacttctgtgttctttttctagcatccctggggattcaatcttgtcacttgtcatttttctgctccctgaagtaaaggcattcaagatatcacatcaccaaaatgaaatccagtcctgcagtattagcttaaactctatgtttggaggcagccagggctctctgacattttgtctgcttccgaccaaagcaatctctaccaccatgtccaaatgcattccatcctggacatcttaatctctgagtaattgcttgtgtacttcctgagttattatctctgacactccttgacagtaatacttgggcacagttgatattaatttattgctttgacaatgaatcagctgaggagttagcattatataaaatgcattttattcctatatcttttgttattttactttcattgttttttagtcctattattctttccaaagaatgttagtggtatgtggttaaaattaaatgcagttatactgttagaaaactaagatggctttaacttaacactgaaattcgtgggtaatgtgtttttcatctctaaaagtgtacaaaattcattttctctgattaacaaagtttttaaagtgtacaactaagtttgtaatctttcccagaatgttttcataggtttatttctttctttgatgttatgaagttgtccgtacaaaaatgacactgttattcaggaatgttgatgtggtaggaaacttctacttatgtctctagaatctaggccatgatgacatatcataaaaatagatgcaaaatgtggctgctcttgcctcttggtgtccatgaggttgcttaatcacacgtctgtacatgtcagcagttaattttttcaaaagtagatgttagtatatgatgatcaaaaattaaaaaaaatccaatggagtgacataataccaataatataataaattatttatcattctcagaactaacccctgttcaacatttatttgtcattacataaaattattatttgaaatattcaagtattatttattgatttacacatagaatcctttcctctagtttgttttcccaagtataagaggcaaatttaattcagaggaaaaaacctcttggaatgacttcaattttattaaaacacatttgaatattgatacttgtcaacaatgccttaatgcacatttcattagatttgctagagtttcatctttttagacaaaagtaggtatgatcagggtgtctttttctgaaatcaatttcacacacacagaattttgtgttttcccatggttaatggatacagtgctcccagatggctttccaacccccaacagaagagacaggaaagagagactggaaaaaccacatgtctattttctggggggcagtttaaataccctgtgggagtggtcttgagcatctctggaggaagggtcatcatttggtggctttctgagatgcggcagggtttgcgggagggggggcttgggtggaacttccaccataacattccagactctttgggtatatggatgccaggggctggggtgaagcatccaccataatgtagacaacacaggctgggcctagccctcagccttccagagctggcaattcccaccatcagttttctataaggccttgttaagttcatttgtgtgacatgtttttcttgaggtttctttttatgtgtggtcaattctaccctgtgataaaacacactgggggaccgtagaagcatgcaggcactctgggagacctttgcaacctaccttcacaccagaagctcactgacctgatagaaaccagatctttgcagagttgtctttgaacttactgaacactcttggccagtaaaggactttttgacttcagaattttttactttacagagtgttcaggatggtggtagctgtcaccagcaggctttcctatggaaaataccagttagagtttatctctgttgccacaaagagcagccaggaaaagccctcaatgaaaatgatcatactggggcatgacaatcatctgcttcctccatttaatggaaaggacatcattggaagaagagcttgttgtgagggaaatggtaaccatctgcacccaaactatgaggaaagcgtcaaataaacagaactttccagactcaaagcaaaaaatagaatcagtaggagcaggagataggaataagtattaaaaaaaaaccccaggaaacaacaacaaaaaatacccctctgtgtttctgattgagagctgagtttgagaagcagcaagttaaaattaaggctaaatttaaaatgaaattaaaaaccttcaatttgagagatacactgtgtttaaaatcaaaaaacacatataattctcatgggactgaatttcagtgaaatgtttgaattaaggaagtaaaagattataaatatatggtcttaaaaataacctgaagttttaaatggctctgaaagacaacctgtcttcctatcccacaagcaggagcatccactctttaaaattataactggcaaaatatgggttatgttggcagaaatctcagaagactcttcatcactcaagagcctcttgtcaagataccttgtaattagctccacaagtctccatctgtgacgatgttaaacacaggtgaattgctctgggcaagttgctcaggtattgtgatgttaacggaatcaattaattgctatagcggctttgtagctttgttcagtatcacacactaactcagagacattcttgccctgcagaaagcatggtcttcctcttccctacccttgtcacttatgcacttgaaatatgaaggtttaggtttgtgatattgttcagcactgaaccaatcccagtgtgtcctgtggaatggcaggattcctccagccagttatcacagtcctatgtgaaggggtctctgcccacacaccgtaatgtgacccttattttcccttagtggacattatgataggccccctcctaaagagagcggcctcgggattctatttaaatttacataaaaatggttgagtgagtgaagaatttttataattatttttgtaactattcaatttgcagcacagttggaagagatgttgtactgggcaaaagtttaagcataaactgaggacccaaatattcatttaacaaaggctgcacatcatgtaatttttcatggccagagtggaaaaagtaaaagaacatgaaaaacttaggtttccctaattattcggtgtcttcctcctcattaatgtttcccagtgcctattttacctgccaaaatataactgaaatcttagcagttaggctgtgaatgtgcctctctccattcttccttctcttgctctggggtgacagtgtcctactctctctgaagatgcaccaaaccaagcacaccagtaatctgtttctaatactccacaccagcattccttccaacactgtctctttcaccactactcagcccccacctttctctgtaggatccgcaggatctggcattaactcaggataacccaagacctagttagcacagacttatttaccccagagggactgagggcagggaatgagagacaaagaaaggggatagagaactggggagaggggcaaaggaacaagggaatgggtcaggggtatttgtcctggaaggaggcacaaaagcctgcctccggatagagaggagagagagatggcacacaggcaaatggcagtttatagaggtaaaaggatgaggtggttaattttaattgaacatgttaattcagtaagtcaaaaggggtttttgaagctgacttcaataagttgatggcttgatcttgttagtcagtctcaggaagagaaagtggccaaaaatgaaatagaccttagtagctagctagctttaggaatgtaatatatcttttttttttttcaaggcagaggaaatgagcaaggcttaccagagccatgtttgccatgctcagtctggctagagtctgttcactttctttcttgagatagggtctctctacatagccctggctgttctggaactcactctatggctggccttgatctcatagatagctgcctgcctcagcctcctgagtgctaggatcaaaggtgtgccccacttttgtctctcttcttttgttgtgttttcttttccctactttacttgtaatcatactgacttatgtattgtttcttttcagttctcagctgatgcagcaccgctacctaaaagattaacccaatctccccacaaagtgccataaacaagctgaagtacactccctgacaatccacagtagtcagtatgatgcatcatgaggtgggaccatcgatcccacggcgggggacaaacacagttactataactgttgtgtcaagatccttgtcattatgcattttagcttcttattttgatgccttcttcattagactatctctgtttggaattgtgatgatacattttctagagtatagttgaaacatgtcctcaacatttgctgggttataaaagccatttatactctgtatgcactgccttggcattccttgcagaattcctctatctaatattttggaggacagttttgttcctgactctgccaaggcctttctaatacccctatacaacaacaacactgtgctggatatatttacttgaatgcagaaatttacatatgtatatatgttagaattttatatatgtacatttccctctctattccctacccctctcaattatggaagttttataggtaccactaacttcttggattggaacctggtgcttgctacttcagtctctgtgatcccaatgtgccctggttagttgattcagtgggtcatgttttcttggtgcctgccattacttctgactcctataatctttccttctcttattcctgggattccctgagttctcagggtggggacacaatggacaccttcaatttagactttctctccccataacagacaaggtctttcaaggaacctagagttcatgagctcagctaaactgaatggctaaactccagggatccacatccaacccctcagcactagtgtaatagatgtgctctggtccaatttttgtatggatgctgaggatatgaactctagttcatgattgtgcaactacatttcacccactgaaccatccttcaggtcctatatgaatgaattttaatgaggtaacttatcagtattttagtaggagcatgaatttgatatgaaaactccccattacacacagttttatcattgtgaaaatctatgtattctcacattgagataacattctttttgctgtctttatcatcacctttaatgtttttttttcttgttatggaatattagtttaaaatgtgttacattcatttaagctgtggaatatttgtttaatgatgcaaagatatgttgcattcatttaactgtgtaaagctgtgttactttgtctgcctaaaatacctgactgctcaaataaagagtcaaatggccaatagctgggtaggagagagaaataggtggtgctggcatgcagaaataataaatagaaggagataagaaagaggagtgagaaaaggagaaggaaagaggatgccaggggcacctctacccagtcatgcagccagccatagaaaagaaggaaagaaaggaacatagactagagaatggtaaaagcacagaggtaaaaggtagatgggataatttaataaaagctggctagaaataagtcaagctaaggtcagacattcattcataagtaagaataactctccttgtatttatttgggatctaggaaatgtgcccccaaagagtaaaaaacaactccccccaaactgtatttactagcatttataactctcttttatatttttaacttgaaatctttaattactactcatatttacatatccatcccgcaccattccctcaccctcccagcctcccatgttccccaccaacctcccctacccatcccccaactccttcccagggatagtgcggcccttcaccagggaccttcaaagtctgtcatattgtttgggggaaggcctaggccctccttgctgtagctgggctgcaatagtatccctccacagggaatgggctctcaaagtccatttgtgctgtagggttaaagactggctcctttgttacaggtcccatagactgtcttggcctcctagctggcacctacattcagagggcttggttccgtccaatgctgtttccccagctttatgactagggtctccatgctttcactaggtcaggtcaactgtttctgcagcaccatcttggctcctttgctcatccctcctccctctccataattggattctaggagtatggttcagtgcttagctgttggtgcctgtttctgcttcgaacagctactagacgaaggctctaggaatggtaaccaaggtagacaccaatctcattataggggaagggcaaaaatggcattttctccaccactgcttggattcttagttggggtcatccctgtggatcccctaacatttcccctgtgccagacctctttccatacctgtactgtctacctctatcaaggcatcttctttcttgccctcctctattcctcccctgtctcagtcctcttgttgtccttcccctccccacctccttcctcttaagtccaataatgttaaattaaattaacttccaataaattttacagttaattcctttaaaagaattagcttttaattttatgacttttttggaaactttaaatactagagtttatagttcatcatatgtaggcaggcataaggttatggcttgaagggtatattcaccacacatttcgtattccttcaactcctgactaagataaagtgttcaaggatcacaaagcccagagctcataggcacaaacaagctaattttattgtatagtatgagtgagaacattgtgagcacaggggaactgatactctgaggtagaataatgttgagcacatgggcactgatactctgaggtagaacagtgtgagcacacgggtactgatactctgaggtagaacaaggttgagcaaatgggcactgatactctgaggtagaacaaggttgagcaaatgggcactgatactctgaggtagaatagtgttgaacacatgggtactgatacacttgcagcttgatgtggaaacagacaatgatttcttggagttcttaactcacagagaagtctaggaacacacagatgggtttaacgatgcctaccaatccagaacctacagacaccttcttctcctatagctgaaccctatactatcagagatggagactgttggaaataggccttctgtttctctctcagtcaggcacatcttatctcatttgataatacagtcatgccaagaaggtttgagatcatgaaaatctcatagttgacaaagaccttttagtcatcgatgtttcattaatgtcacaagaacatccaaatttacccaattaccttctattatgcaaatactcaagtgattgcatttagattttatagaggacatgcttatagtattataaaggaacacctgcaatcatatttttccttttctttcaaattcccaactaatccattgcacacaacaaacacaatgaggacagttggacttgtgctgtgttgttagacaatgcttgctttcaaattcctttacaaagccataaaaacaaacagaaaccagaaacagagttgggatatttttctttttaaaaattttattatatttattttgtttatatattatatgttatatatatataaagtaccttcccccgcctcctctctcccccagatcaattcctgtttctcttaaaaaaaaaaaagcagacctcccagggatatccattgaacatggcctaagaaaatacattaagactgggcacaaattccaatatccaggttggatgtagcaacccagtaggaggaaagaggttccaagctcaggcaaaagagtcagagacaccctgactcccagttactgggagtcccacaagaacaccaaactacacaatcattaggatgagttcttaaaactagttaagttttaagactttaaaaaaaaagagagaaagaaagtaaagagctttgtattatgtaatttaaaaatgtaggtagttgatagctttaaattttacttttcaagttggatatttcccaaatttttgaaaacaacattatctggttagttaaaagaaaacagagaacacaatattattgtttgttatgaaagagagtcattcttatgcagtaaaagcagaatattctgggggaaattaatttcctgtgccctataaactaatctaaaaaggaaaataatagctggtatgcagccatttgctaaccacattcatgcaaatatctaaagacttattcatgacatggacttggtttccccatcaatatcctacaggatctcaggaaagctgggggaattttcaccggatattaggatggggacatttggtggctgcatagaccatgcctctggagatgaaatactggccattaagggtcaggaactgaatagaaagcatggagctcacattcttccctagaataacaaccgtagttttaaacattgatcggtttaacttctctttttaaaatgtctaaagttattatcttttttttttaatgttaaggcacactcgggcttctttccttcatgcaagctctattatccattatattacatccagttaatcaaattccattagattttgaatttcaaaattttatttctgcaaaattgtattctctcaaaagtagaaatccagttgtctaatgaaatgttagaatgatgagggcataggtagcttttgagtgtgctttagaaagttactatttttaccaaaatctctcagttcctcttttatgtcattggtcattggtattctcccttcttgttctacccatatgttactttgtcttttctaaatgattatttcatgggatccctctcactatccaggcagtctttttcactgcaccgtatataattcctttaccttttcaaggcctgcttaagaatctgttcttccttacattcaaaaatttattaaatttgttcttggactattttgaacatttattctatgcatgctgaccactttcattccttaccatccttatccatggtctcttctctacttaaatatttctcacatttagatatatttggttttttttttttttgcgaccctttgacataaacaaggactgtctgtatgaccatgcttttggacctggtggactcagcagcaggtacacaactgaagacgtcaatacatcttcttccagtatctatcaagagcccctagatcagcagtaaagagtaccagcctactgagctgcctaacctctcccttacttccttggctggtgggagtgttgttcagtatgggtccagtgcagataactagagttgtgaattgatggttgaaatggttacattgagtccaaagaatggtattttgcagcccttcaccttattgtccatctctttcatattttctgccccccattccacaataatataatgtttaggtcttagaggaggtgaaaagcccgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatctcccctgttgttcaggtcagctatttctgtgggtttcaccagcctggtctggacccctttgctcatcactcatccttttctgcaactggattccagttcagttcagtgattagttgtgtctgcttctacttccaccagctgctggatgaaggctatagcatggcatataagacagtcatcaatctcattatcaggagagggcatttaaggcagcctctcctctgttgcttagattgttagttggtatcatcgttgtagatctccagacctttcacttgtgcctgatttctctgtaaacgtaaaatgtctcccccaattatggtatctcctttcttgttttcttctattcttccaaagtggattttctaagtctaaactaaaagtgaaatcctagtatgagtttttgataactatcttaatgctcagtgtttactaaattctaaattagcacctgtgaggagtttatgttttcaaactggtcattgcataatatacttttttaaaaaatggaaaatgttatgaggatataattcagaattcttaatctaaacttgaaaattggctatggaattggacttggaaaaacacatttatagtgtatcctacggttgccagagttagtcattggcaacaaacatcccctccctgttttactgtgcacccctgtcctggcttctgaggacattctgcagaatgttgagtcatagccttctcccaagtcacctactgtggacatactaacagatttagaaacaagagtgacattgttccccccttaggcaagggaaaaatggaaagatggtaaaggaatcacagtaggagcagtgggtttgaggaagtaccatgtttcttcagatgtatgctggacatctggcagacaaaacatgtctgttgccagttgccagcatgagccaggaggaacactattacacatcttggaaaatggtttttggaatgaaccattttggattttgactttcttccttaaagaaagaatgaccttcagcacagtaaagaaaggaaataaggcattacagaatcagcatcactggaggttttgatgccccttctccagcctaggttgagtggtattccctgagtgttccagcatccgggtttgccccaggtttatgtttaaagaatgatgtactatcagcctagttcttttgcctcattgatttcttcttcagtctgtaatggcaggaaaaattgcatccactaccttagcttttatttccagtgcttggcataacaatagatgatagatttttgttgagtaaattatcaacaggtgggcattatattattttatggtctctttcatggataaatttattttataatatgaaagcatttttattgtaaaaggtactgagcaactaaaacatttaagaaagaatgaacccacacagggaatcttgacttactcactctgtgtgctacaccagagggctccgtttttgattttcagtattggatttctgctctcttcctgccatgtaccccaatgatctaagtctaaggctcaaaatctgttccattacttagtaaggattgatgaatatggcattttcctttaagataacttaatgccacatgaaacttcttgtttctttcactcctcacttatttgatgtctgtttttacaaaggcatcctcaactcatttccaaatgacagaaggttgctgttgttttacagtctaggaatgtctcagattaatgttttcaagatttagttgtaattaggaatataaacagaattaagcaaactcttgccagaagagaggaagattctagaatactatttcaaaaagctcctgaagagcacctagagtgggaagatagaattgaattcatgagtgtggttgtggtgccctgaatgagacgagtcctggaagctcttttatttgaatgattggtcctcagttgggagagtagtttggggaggaataggaagtttggtcttgtcagagtaggtgtgtctgtcactgggtggaggggttggtgaggtttcaaaagcctatgcccaggtctctctctctctctctctctctctctctctctctctctctctctcgtgcttgtggatcagatgtaagctctgagctactgccttgtgccgtcacctcctgtctgctgctatgctccccccatgatggtcatggactctaaccctctgaatctgagaggcttcaaattaagtgctgtctttcgtaagttgtcatggtcatggtgctttgtcacagcaattgaagagtaactgagacagtcaatgtacatgtagaatttagaatgcatataaaggacacatgtgtgtaaaccttcacaaatatgtttctaaaaagacaatttcataactttccatagctcttgtatattttgttatttatgggtaagaagctgaccctaaaattctcttttgctggtcccaagtttgttcttgtagtagataatattcattaaggtttgatggataagtgaatattgagcaaataagttaattgctatttctttttcagattggttaattcattgggatacactcacatttcacggcatattgatttataatacccttgaagtatttcccctccaaattcaatgctcatttaaaaaaatatttttatatgtttatgagtagagaaattcagcatacttttactttattagtttagtggcaagtcattaacaagaaaaggtcctaccttatctttcagtacaaacttaattttataatccacattttaacaaatatttatatattcttatatgattttcacattggttaaatgctttgttagcaccacataaattttctttagctaattggttaacaactaattactgtaaaaaattgaaaatgttaaatcttctcatgggaatttgaaaaaaatgtcaggggtgtactcttcttttatattttcctcaaagtcttggtgtttcgatgaatttgcaataatgattaaattaataatgaaaaatagctaaatggtataaaattaatacttgagagctttaaaattatagcaaagcttatgcatattcaccttccctctgtgtaagacttttgattagttcttgtaagtatggaacacacttgaaatatacaaataaaatgttatttctttgaaaatcatgtaatagcccaggattaaaataaaccatgtttgcatccagtatggtctctatcttactattggcacaacaattggctttagaatgaaagatatattctaaagatatatatatatatatatatatatatatatatatatatatatannnnnnnnnnnnnnnnnnaaagaatcataagtaaacaatattcaccaaattaattcaacaaaattcctggtacagttttaggatatcagcatatgttaaggagaaaaaccaaataagttatggagttgtaattgtatcgtgaagagaccaacaatgcatacagcagtgaaagctatcacataaaggaaaagggaaagcaggcataaagggagagtgaagctagatggagtggtggtgacctataatcctagcacatgatgggctgattcgggaggatcaagggtttaagtctatcccaggtctaggctagcctggggacttagtgcaatcctgtctcaaaaaactaccacaaattaaaacaaaacagaataaataaaggagagagtcccaagcatcagtggatttgagcatcatggttttgtgtgtgtgaagtagtcaggaaaagtagtgggctttctgcagaaagtaaccttcgactgagacctacaggtgaagaaggaaatcaggtaggcaaatatttagcacttgatcttagctcaaatgctgggcagctgcagaaaatatgtgtgtgtgtgtgtgtgtgtgtgtgtgtgtgtgtgtgtgtgtgtgtgtttacaaaggatagatatttattcatacagaaattactacttagatctctatataaaatgtttatatattatataattcatattaaacacatataatgtttacttgtataaagtatgttagaaccacctaaatactgtatgaagataggtgaataggatcacatcattctctgtactgtttttgcatctattcagggacttgagctgtgtattacatctctgtgtgtgagtaaactaacaacaataacaattccttaacagtctgaaagtccttgcagactgaattatagatgagcattgcacaaaggtatgtgtagttttagcttcataacttggccacaattgtttacatttccaaaaggcacatggaaagaaacctaagtaatacctaataagcgagtctttgcttttcatttttttccattttaagtcaagtaaaaccagaagttttgttagttaacctgaaaagcttttgtgtatgattaaaaaaccttcaatggcagtattaaggaaattatctctgtcataatttaccaagcctgtttatttgtaggatgccctgcaattgtgtgggggtcatcttctttgtaatttctcagatttttcatgttgttttagattataaaataaaatcattcttaatggaacaggaatttagctcagctcaataacctttggatattatggtaggcaattctttcatccctgtgacagaaactcaggcaacttaagggtatttttgttaaaatttccaaagtttaaatcagtgctcactggatgtttctgcttcttggcttgtatgtggtgagacagtttcagggtaggtatgtgtagagataagtggcttacctctggcaaactggaaggagagagaaaaacttacaggaagtggccagagccagtgatccacttcctccagccccactccatgtgataataaccaattcagctgtgaacacagtgctttgatccattgatggagctagaacatgcatgacccagccatctctgaatagagcaagctgggaaccaagacttgggcactccctattcaaacacaaatgcctactcatgttcacttagcccagtggcaaagagcacagaaaatgataatttggacgaatatcctaaaaatatatttgcacttggtaccctattacaatcaaagtagatttaacaacagaacccttctttactcacctacctgcctacacgccaggagcttggggctgaagtgaaaacttcagttagaggcttcagatgcctctaacttttaaaggccgagaaacaaaggcatggcatttactcctggcatttactcattagaggctaaagggaaaaatgagtgcccttcttcttgtcttttcccatggtgattggcgctctagagtggaaggtactttgatcagaagagtctctggaagccaggctaagctgaagttggccatccttgctagagacagtgtctgtgtccagagagatgggtggtactgtttgctgttgtttcctttgtgccacaagaggacactgaggtcagtatgatagacagagaagctttaaacaattgtatgccagaccttcacaacccagtcaaggaatgagctgatctccatcaggaatccaattgttcttcaagataagctgttaggaccaacactttcttcttcctatctgatctcacagaggtcttgacaccagagacactctgtcaagagccaccttgttacccatttcctttcaattcaaaacaactatctgaagaccatgtcctctgggaatttaggtgggaggaaagatatggaagtgctatttttcaataaatgttcacaggctagatatttttctttgaccaccatccatgctatgaaacagataaagtcataaggcatcagtcaaaattcctgagatgggcactattttgggtcctaaggaatttacagctcaggagaaaaaaattgatcagaataaatatttgtctgagtaagcaaggagaatttattatagtgtaagggcactacataatttctacaggaaagaccttcagtatttaaaagcccttaggctatttgcaattatagttttaaggcatgatagtaatattcacatggatttaaatcattttcttcaggttctatgaagaagaacactagttgcatgatttaggaagcgtgtatctctgactcagaaaggtttcaaaacacatctttcttttatttttcaagaatttatttatttgtgtgtgtgtgtgtgtgtgtgtgtgtgtgtgtgtgtgtgtgtgtgtgtgtgtgttgtgtgtgtgccatgtgtgtggggttaccccttcgatgcaagaagaggttattgaattcctcggagctggagttacagggcattcagggcattatgaactttgggtactggaaactgaggagtagcaaattagctcacaacccctcctaatgtctctccagcctgtcccctccttccccacctcttttttttttttttttgagattaggtgtcatgacataccctaactgactttgaacttgagatcttctatgaagttatcttttgcacacatactatatatgaagggatggtaatgtggagcatgttagctcatagatggcaaatggcagctttaaaatctagtttgtaattgtttattgttataagatgctgggattgctctgccatctagtgattaagaactggatttagacaattgaattagaaagcacacaagatttgtaagaaaacagatctatgaaaactttttataaatgcaggaaaattgagttgatttcaagtaaaatatgatcaaacaaaatacatttctccatctagatacacatgccagggctttgtgggtgacttcagaatggagtcagtctgctggaatatttagtaaggggaaaacaattctgtagcttggaagttaaaacatggtaaaaatatggccagacttcaaccacttttaaattttagaggcattaataaactataagtagcaaaaagtgtaggtagcataaaattacagatttgtagggtgtaagtgtgcctgtatgtgtgcgcatgtctgttttctaggactcaaatctagactctagatgtgagcctggattatgttctgaattaagtagcagagtcttgaggcactattagagttattcatactctattttgttattcatacaatagttatgtcgtgaccacatctttgtaattctttcaacaaactggccaccattttgtttcctattctacttttcgtctaagtaaatggccgtgtagaaacacaaaggacattggccatattatacactactgccatgtagaaacacagagaagtgcaagctctctattttctaaccactctggctttacacacatctttcattcagacttgcacagcgagatttcactgagccctctgtgataggaacagattcctgtgtgggcgaagagaaggcatgcctcagtagtgaatgtgggttttcatcttcttgccatttaaaggcatgccaattacatgtccatatcatcttaaatttaattataaattctcaggggaaagagaccagtgatgaatcagagtataaaaccagtttttggtgttgtaatttaaagaaagcaatgcagtgactctttctccgccccttgaattgtgatctcattgtcttaaacttccaggaagaa

(The sequence listing continues in the following parts.)

What is claimed is:

1. A CHOK1SV glutamine synthetase knock-out cell comprising (i) at least four distinct recombination target sites (RTS), (ii) an adenovirus (Ad) gene comprising E1A, E1B or a combination thereof, and (iii) a promoter operatively linked to the Ad gene, wherein the RTS, the Ad gene, and the promoter are chromosomally-integrated, at least one RTS, the Ad gene, and the promoter are integrated at a single chromosomal locus, the chromosomal locus is Fer1L4, ROSA26, HGPRT, DHFR, COSMC, LDHa, MGAT1, GRIK1, NL1, NL2, the first intron of MID1 on the X chromosome, or Enhanced Expression and stability regions, wherein the CHOK1SV glutamine synthetase knock-out cell is a Chinese hamster ovary cell adapted for growth in suspension and serum-free medium and having glutamine synthetase gene knockout, and wherein the CHOK1SV glutamine synthetase knock-out cell comprising (i), (ii) and (iii) expresses E1A mRNA and E1B in an amount sufficient to produce adeno-associated virus (AAV).

2. The cell of claim 1, wherein the cell comprises four RTS.

3. The cell of claim 1, wherein the cell comprises six RTS.

4. The cell of claim 1, wherein at least one RTS is selected from the group consisting of SEQ ID NOs.: 1-30.

5. The cell of claim 1, further comprising a site-specific recombinase gene.

6. The cell of claim 1, further comprising a second Ad gene, wherein the second Ad gene is chromosomally-integrated.

7. The cell of claim 6, wherein the second Ad gene is located between two of the RTS.

8. The cell of claim 1, further comprising an adeno-associated virus (AAV) gene, wherein the AAV gene is chromosomally-integrated.

9. The cell of claim 8, wherein the AAV gene is located between two of the RTS.

10. The cell of claim 1, further comprising an AAV vector cassette, wherein the AAV vector cassette is chromosomally-integrated.

11. The cell of claim 10 wherein the AAV vector cassette comprises a reporter gene, a selection gene, a gene of therapeutic interest, or a combination thereof.

12. The cell of claim 1, wherein the cell is substantially free of helper virus.

* * * * *